US009670480B2

(12) United States Patent
Hoe et al.

(10) Patent No.: US 9,670,480 B2
(45) Date of Patent: Jun. 6, 2017

(54) **GENOME-WIDE CONSTRUCTION OF *SCHIZOSACCHAROMYCES POMBE* HETEROZYGOUS DELETION MUTANTS CONTAINING GENE-SPECIFIC BARCODES BY THE METHODS OF 4-ROUND SERIAL OR BLOCK PCR, OR TOTAL GENE SYNTHESIS THEREOF**

(75) Inventors: Kwang Lae Hoe, Daejeon (KR); Dong Uk Kim, Daejeon (KR); Mi Sun Won, Daejeon (KR); Hyang Sook Yoo, Daejeon (KR); Dong Sup Kim, Daejeon (KR); Han Oh Park, Daejeon (KR); Kyung Sook Chung, Daejeon (KR); Young Joo Jang, Seoul (KR); Mi Young Nam, Daejeon (KR); Sang Jo Han, Daejeon (KR); Shin Jung Choi, Daejeon (KR); Seung Tae Baek, Daejeon (KR); Hyong Bai Kim, Seoul (KR); Kyung Sun Heo, Daejeon (KR); Hye Mi Lee, Daejeon (KR); Min Ho Lee, Daejeon (KR); Jo Young Park, Chungcheongnam-do (KR)

(73) Assignee: Korea Research Institute of Bioscience and Biotechnology, Daejeon (KR)

( * ) Notice: Subject to any disclaimer, the term of this patent is extended or adjusted under 35 U.S.C. 154(b) by 1397 days.

(21) Appl. No.: 12/989,192

(22) PCT Filed: Aug. 27, 2008

(86) PCT No.: PCT/KR2008/005031
§ 371 (c)(1),
(2), (4) Date: Feb. 17, 2011

(87) PCT Pub. No.: WO2009/131279
PCT Pub. Date: Oct. 29, 2009

(65) Prior Publication Data
US 2011/0190163 A1 Aug. 4, 2011

(30) Foreign Application Priority Data

Apr. 22, 2008 (KR) .................. 10-2008-0037420

(51) Int. Cl.
| | | |
|---|---|---|
| *C40B 50/00* | (2006.01) | |
| *C40B 40/02* | (2006.01) | |
| *C40B 30/06* | (2006.01) | |
| *C12N 1/00* | (2006.01) | |
| *C12N 15/10* | (2006.01) | |
| *C40B 30/00* | (2006.01) | |

(52) U.S. Cl.
CPC .......... *C12N 15/1034* (2013.01); *C40B 30/00* (2013.01); *C40B 40/02* (2013.01); *C40B 50/00* (2013.01); *C12N 1/00* (2013.01)

(58) Field of Classification Search
None
See application file for complete search history.

(56) References Cited

FOREIGN PATENT DOCUMENTS

| KR | 10-2006-0086990 A | 8/2006 |
|---|---|---|
| WO | WO 02/053728 A2 | 7/2002 |

OTHER PUBLICATIONS

Krawchuk et al. High-Efficiency Gene Targeting in Schizoaccharomyces pombe Using a Modular PCR-Based Approach with Long Tracts of Flanking Homology. Sep. 30, 1999. Yeast. vol. 15, No. 13, pp. 1419-1427.*
Shoemaker et al. Quantitative phenotypic analysis of yeast deletion mutants using a highly parallel molecular bar-coding strategy. Dec. 1996. Nature Genetics. vol. 14, pp. 450-456.*
Pasrija et al. Squalene epoxidase encoded by ERG1 affects morphogenesis and drug susceptibilities of Candida albicans. Journal of Antimicrobial Chemotherapy. vol. 55, pp. 905-913.*
Sequence Alignment of Seq Id No. 7922 with EG672566. Search conducted on Mar. 4, 2014. 1 page.*
Sequence Alignment of Seq Id No. 7923 with EK826663. Search conducted on Mar. 4, 2014. 1 page.*
Baek, S.T., et al., "Genome-wide Drug-induced Haploinsufficiency Screening of Fission Yeast for Identification of Hydrazinocurcumin Targets," *J. Microbiol. Biotechnol.* 18(2):263-269, The Korean Society for Microbiology and Biotechnology, Korea (2008).
Park, J-Y., et al., "Drug-Induced Haploinsufficiency of Fission Yeast Provides a Powerful Tool for Identification of Drug Targets," *J. Micriobiol. Biotechnol.* 13(2):317-320, The Korean Society for Microbiology and Biotechnology, Korea (2003).
English language abstract of Korean Patent Publication No. KR 10-2006-0086990 A (listed as FP1 on the accompanying form PTO/SB/08a), 2 pages.
International Search Report for International Application No. PCT/KR2008/005031, Korean Intellectual Property Office, Daejeon, Republic of Korea, mailed on Mar. 11, 2009, 3 pages.
NPL5 International Preliminary Report on Patentability, including the Written Opinion of the International Searching Authority, for International Application No. PCT/KR2008/005031, The International Bureau of WIPO, Geneva, Switzerland, issued Oct. 26, 2010, 6 pages.

(Continued)

*Primary Examiner* — Channing S Mahatan
(74) *Attorney, Agent, or Firm* — Rubin and Rudman LLP; Judith U. Kim

(57) ABSTRACT

A method comprising transforming *Schizosaccharomyces pombe* with a deletion cassette, constructed by four-round serial PCR, block PCR or total gene synthesis, containing a homologous recombination site is provided for preparing gene-targeted heterozygous deletion *Schizosaccharomyces pombe*. Also provided are gene-targeted hetero2ygous deletion *Schizosaccharomyces pombe* mutants prepared by the method, and a library of gene-targeted heterozygous deletion *Schizosaccharomyces pombe* mutants. Further, the library is useful in constructing a method and a kit for screening a drug's modes of action.

11 Claims, 60 Drawing Sheets

(56) References Cited

OTHER PUBLICATIONS

Chung, K-S., et al., "Identification of small molecules inducing apoptosis by cell-based assay using fission yeast deletion mutants," *Investigational New Drugs* 26:299-307, Springer, United States (2008).

Giaever, G., et al., "Genomic profiling of drug sensitivities via induced haploinsufficiency," *Nature Genetics* 21:278-283, Nature Publishing Group, United States (1999).

Extended European Search Report, which includes the supplementary European Search Report and the European Search Opinion, for European Patent Application No. EP 08 79 3534, European Patent Office, Munich, Germany, mailed on Aug. 18, 2011, 7 pages.

Office Action for Korean Patent Application No. 10-2008-0037420, dated Feb. 25, 2011, Korean Intellectual Property Office, Republic of Korea, 6 pages.

English language translation of Office Action for Korean Patent Application No. 10-2008-0037420, dated Feb. 25, 2011, Korea Research Institute of Bioscience and Biotechnology, Republic of Korea, 4 pages.

Huh, et al., "HCS Drug Target Screening Technology Using Haploinsufficiency," *Studies on Chemical Genomics*, 1-56, Korea Research Institute of Bioscience and Biotechnology, Repulic of Korea (Feb. 26, 2008), 58 pages. Summary only in English.

Kaur, R., et al., "PCR-mediated direct gene disruption in *Schizosaccharomyces pombe*," *Nucleic Acids Research* 25(5):1080-81, Oxford University Press, England (1997).

Tatebayashi, K., et al., "Structural analyses of DNA fragments integrated by illegitimate recombination in *Schizosaccharomyces pombe*," *Mol. Gen. Genet.* 244:111-19, Springer-Verlag, Germany (1994).

Office Action for European Application No. 08793534.2, dated Jul. 11, 2014, European Patent Office, Munich, Germany, 6 pages.

* cited by examiner

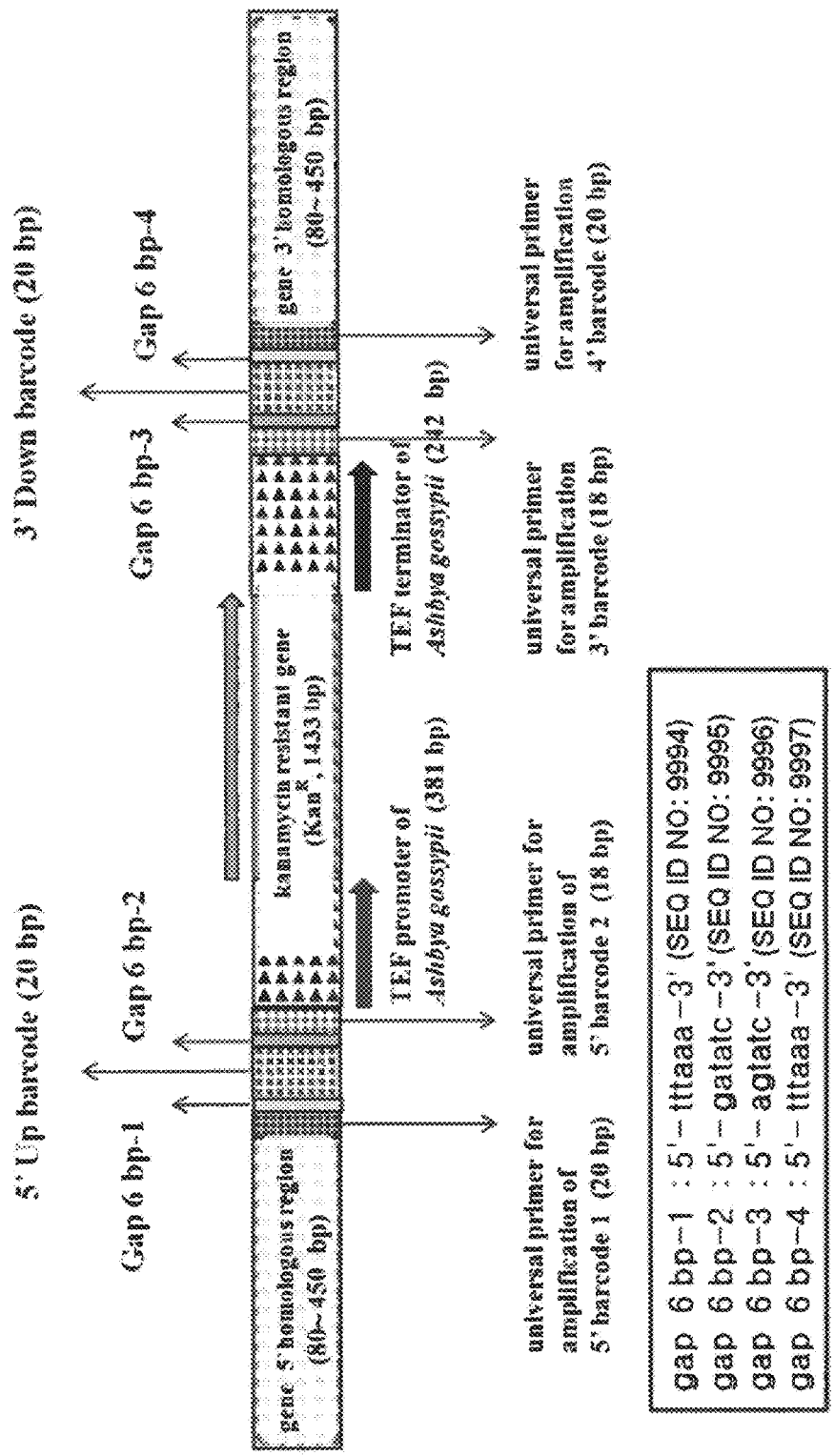

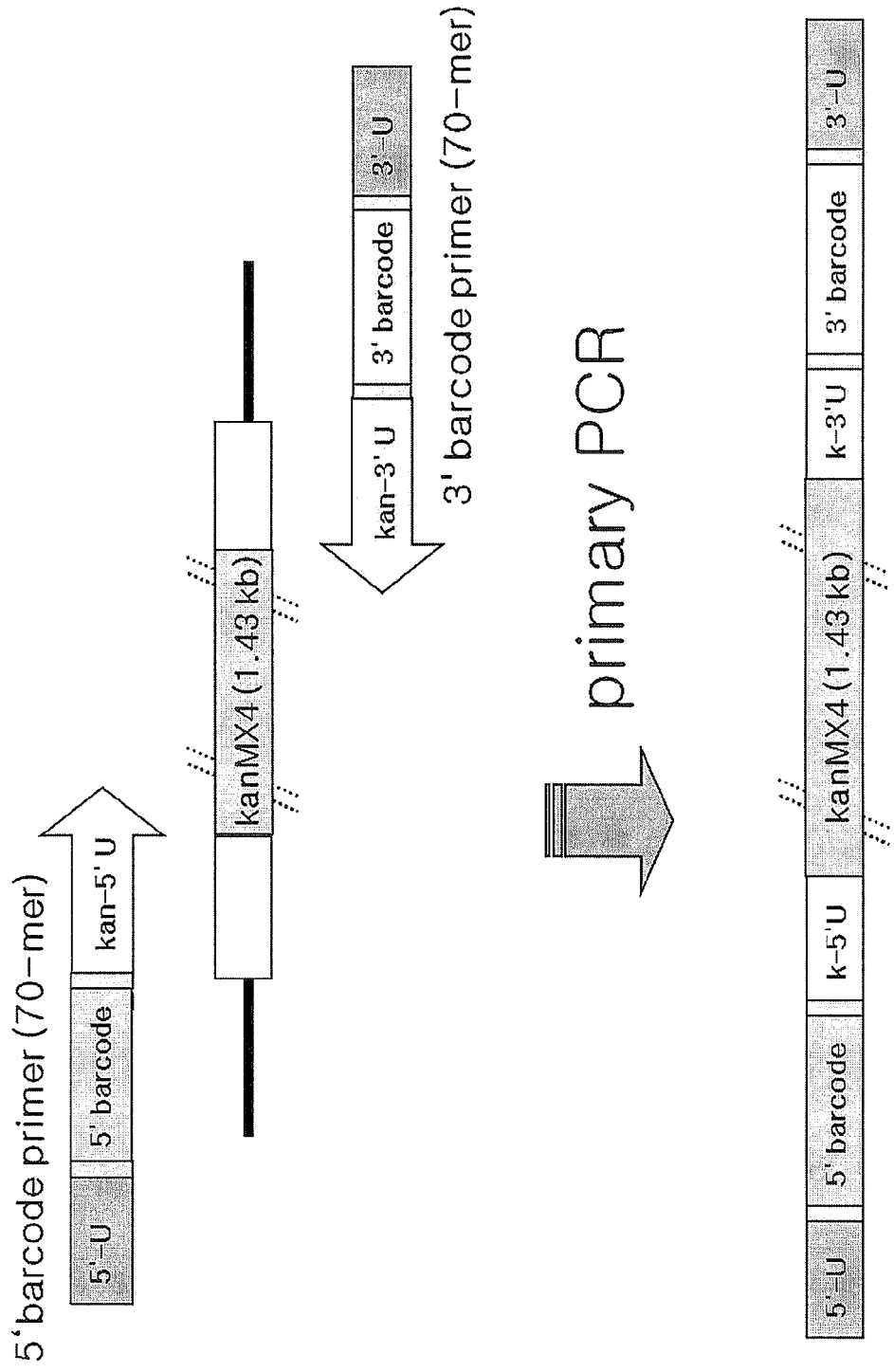
FIG. 2 Process of Constructing KanR-Barcode Module of Deletion Cassette

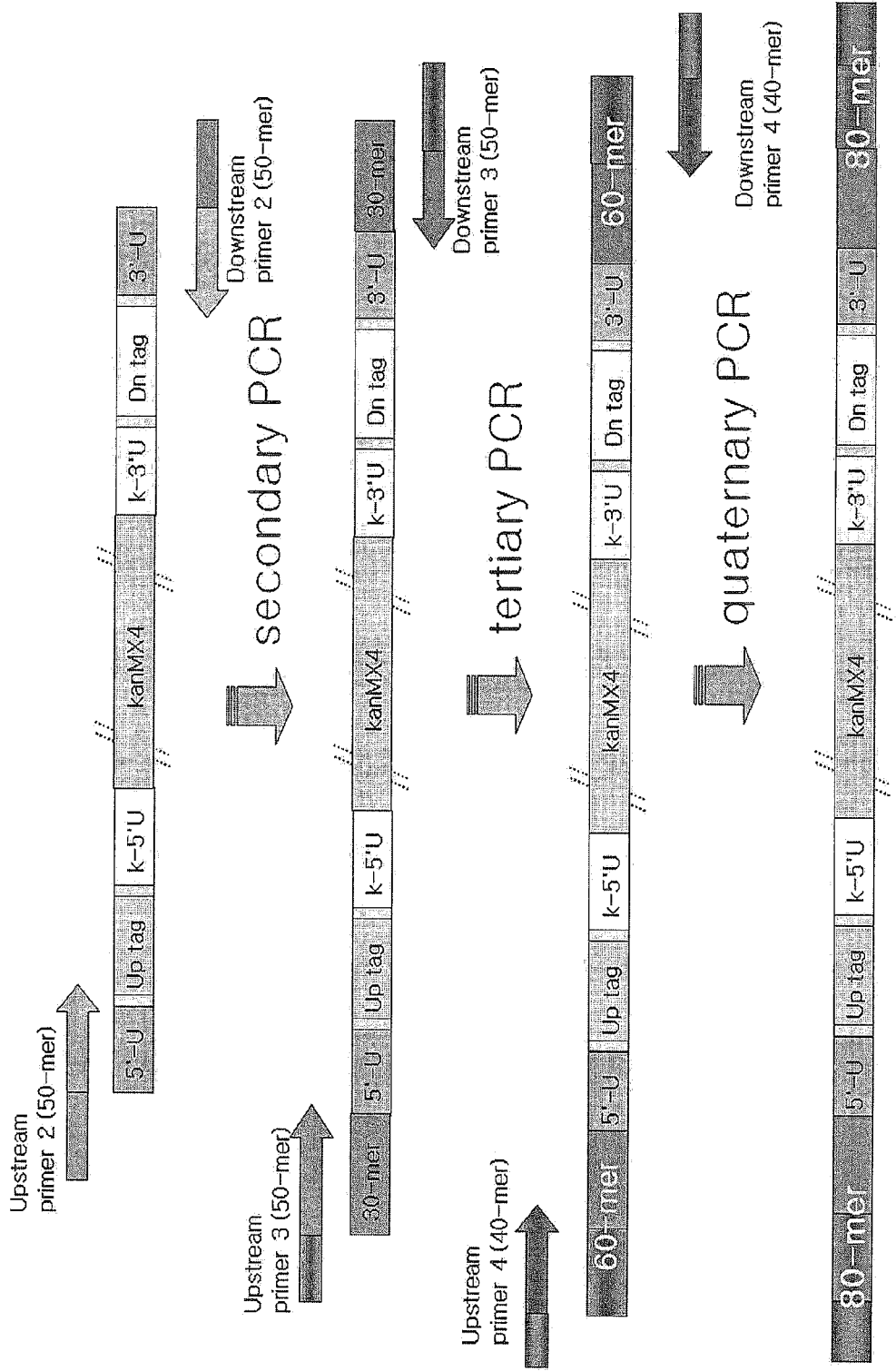
FIG. 3 construction of deletion cassette by 4-roudn serial PCR

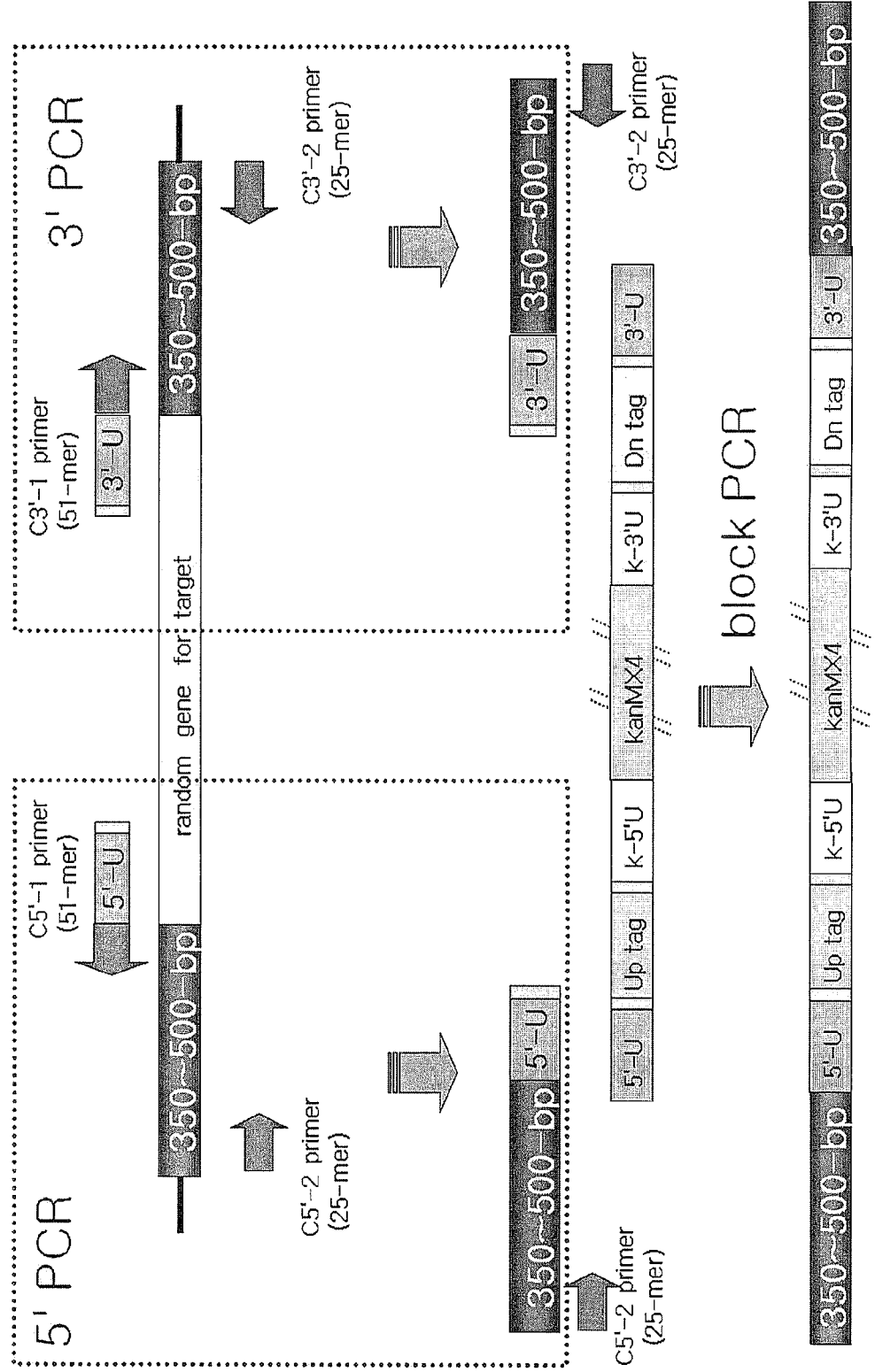
FIG. 4 construction of deletion cassette by quadruple block PCR

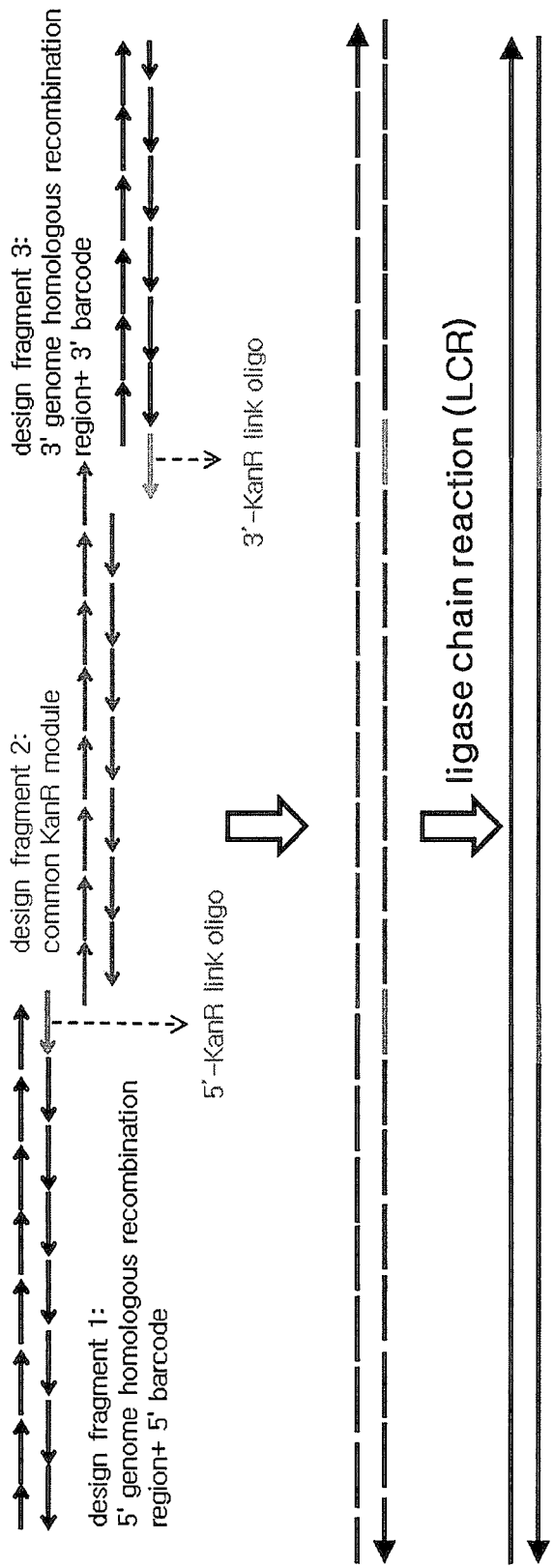
FIG. 5 construction of deletion cassette by gene synthesis

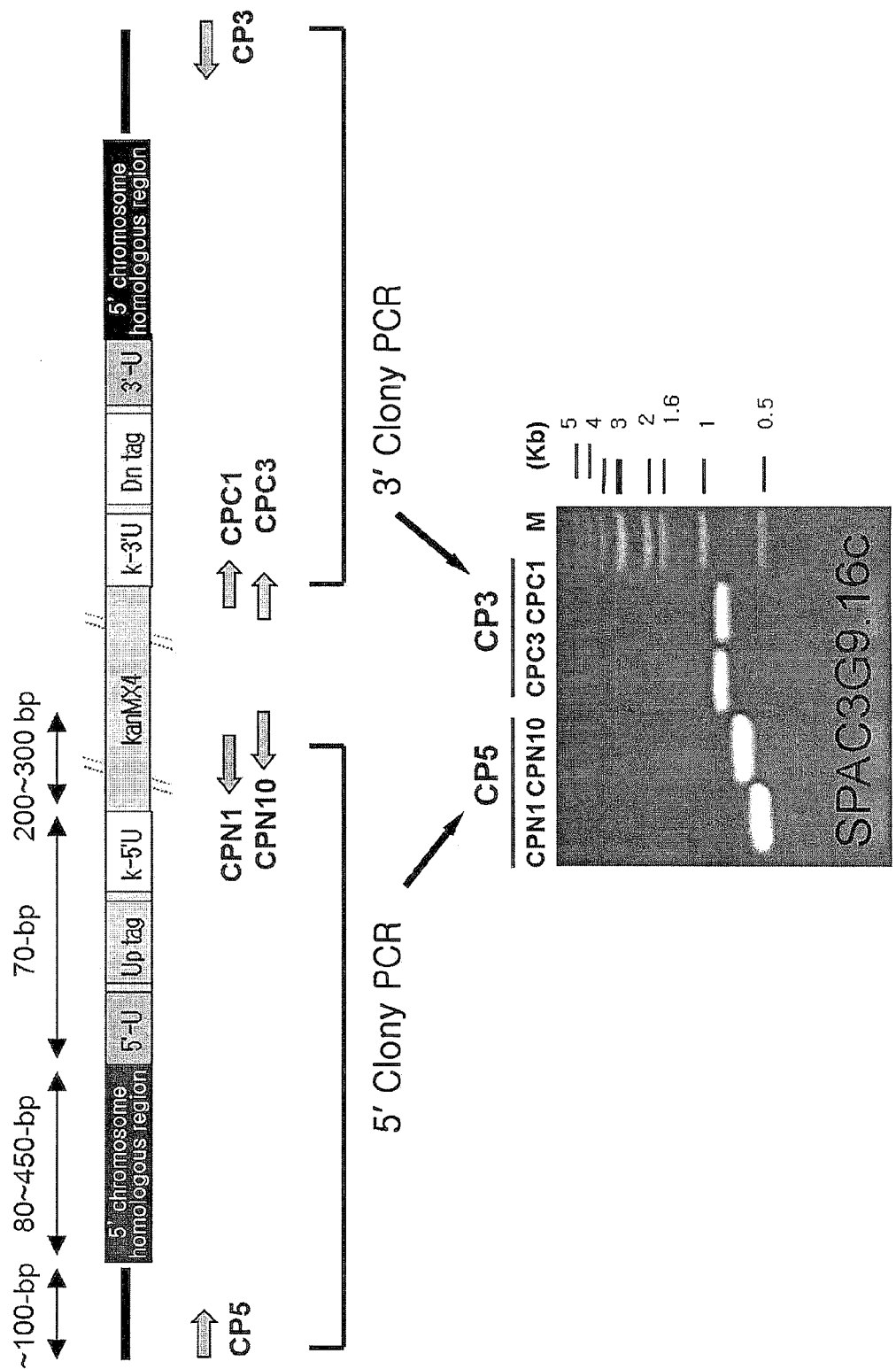
FIG. 6 colony PCR of prepared strain

FIG. 7

| Sequence number | Name | Base sequence |
|---|---|---|
| 1 | CPN1 | CGTCTGTCAGGGGAGCGTTT |
| 2 | CPN10 | GATGTGAGAACTGTATCCTAGCAAG |
| 3 | CPC1 | TGATTTTGATGACGAGCGTAAT |
| 4 | CPC3 | GGCTGGCCTGTTGAACAAGTCTGGA |
| 5 | U1 | GCTCCCGCCTTACTTCGCAT |
| 6 | U2 | CGGGGACGAGGCAAGCTAA |
| 7 | D1 | GCCGCCATCCAGTGTCG |
| 8 | D2 | TTGCGTTGCGTAGGGGGG |
| 9 | at_KRIBB_SP1 | GTCGTCAAGATGCTACCGTTCAGGA |
| 10 | 5U-Block | CGCTCCCGCCTTACTTCGCATTTAAA |
| 11 | K5U-Block | GGGGACGAGGCAAGCTAAGATATC |
| 12 | 3U-Block | TTGCGTTGCGTAGGGGGGATTTTAAA |
| 13 | K3U-Block | CGCCATCCAGTGTCGAAAAGTATC |
| 14 | 5U-Block (rev comp) | TTTAAATGCGAAGTAAGGCGGGAGCG |
| 15 | K5U-Block (rev comp) | GATATCTTAGCTTGCCTCGTCCCC |
| 16 | 3U-Block (rev comp) | TTTAAAATCCCCCCTACGCAACGCAA |
| 17 | K3U-Block (rev comp) | GATACTTTTCGACACTGGATGGCG |
| 18 | SPAC1002.09c_UP | AACGGCTCAGACCACTGTCG |
| 19 | SPAC1002.09c_DN | GAAAATGGGAGGGAGCGCGC |
| 20 | SPAC1006.08_UP | CTCCGTGGTCACAACCCGAA |
| 21 | SPAC1006.08_DN | GTCCGAGAGTCGGCACGAAT |
| 22 | SPAC1039.11c_UP | TGGAGGTTGAAAGGGGGGCT |
| 23 | SPAC1039.11c_DN | CAAGATGCTGCCGGGAAACG |
| 24 | SPAC1071.01c_UP | ACGGATAGTGCCCTGAGCTG |
| 25 | SPAC1071.01c_DN | GCGTGTAGTGCAGCTGTGTC |
| 26 | SPAC1093.01_UP | TCAGGCTTGGGATCGCGGAA |
| 27 | SPAC1093.01_DN | GATGGGCGGCAGCAGATAA |
| 28 | SPAC10F6.01c_UP | GCACGGGGGGAAACTCACAGC |
| 29 | SPAC10F6.01c_DN | TGTATGTCGGGTGGCGGGTA |
| 30 | SPAC10F6.03c_UP | CTCTTTCGTCCGCCGCTTCC |
| 31 | SPAC10F6.03c_DN | CAGGGCGTGAGTGGGGCAAG |
| 32 | SPAC10F6.17c_UP | AGATCCGAGGGGAACCCAGC |
| 33 | SPAC10F6.17c_DN | CCAATGCTGTAGGCGGGGTC |
| 34 | SPAC110.04c_UP | GCTGGTCCACAAAACGCCCT |
| 35 | SPAC110.04c_DN | CGTTGCGGTTTATTGCTCGC |
| 36 | SPAC1142.02c_UP | GTTCGTGCCCGTCTTTCCCC |
| 37 | SPAC1142.02c_DN | TTCTGAGCTTGACGGGGCGC |
| 38 | SPAC1142.08_UP | TATCTGCGCTAGGGGTCGCC |
| 39 | SPAC1142.08_DN | TGCCCCGCGCTTCCTTACC |
| 40 | SPAC11E3.01c_UP | GTCTGTCGTCGTGTGCGCGGG |
| 41 | SPAC11E3.01c_DN | TCTCTCGGCAPTGGGGGGGT |
| 42 | SPAC11E3.03_UP | CGTACACCGCCGCAAACAAG |
| 43 | SPAC11E3.03_DN | CCCACAAACAACGGCACGGA |
| 44 | SPAC11E3.07_UP | GCTCGGGGGTAGGGTGGACA |
| 45 | SPAC11E3.07_DN | CACCCTTCGCTGCCCATTGA |
| 46 | SPAC11E3.15_UP | CGTTCGATGTGGGGGTTTTT |
| 47 | SPAC11E3.15_DN | CGAGCCCAATGCATAGCCCC |
| 48 | SPAC11H11.06_UP | GGTGGCATTGGGGCTTTCGA |
| 49 | SPAC11H11.06_DN | TCCATCGCGAAACACAGCCT |
| 50 | SPAC1296.01c_UP | CCGAAAACCGACCGAACACC |
| 51 | SPAC1296.01c_DN | CGGAGGGTACGCCAATGGAA |
| 52 | SPAC12B10.01c_UP | CCCGTCTGCTCGCCACTTTG |
| 53 | SPAC12B10.01c_DN | GAGCGGGTCGGGAGAGGTTT |
| 54 | SPAC12G12.02_UP | CCCCAAGACAACGCGCCAAC |
| 55 | SPAC12G12.02_DN | TTGGCGCGACGGCTAGCATCT |
| 56 | SPAC12G12.14c_UP | ACGGCTCGATGAAACCCGTG |
| 57 | SPAC12G12.14c_DN | GCTCTCCATCGACGTCCGC |
| 58 | SPAC12G12.16c_UP | GGTTGTGCAGCGAGGGCGTT |
| 59 | SPAC12G12.16c_DN | ACCCCGACCCGAAAGCCATC |
| 60 | SPAC139.01c_UP | TCCCCCGTGGCTCTTCGTTT |
| 61 | SPAC139.01c_DN | GTTTCAGTCAAGTCGGGGGC |
| 62 | SPAC13A11.06_UP | ATACCAGACCGTTTCGCCG |
| 63 | SPAC13A11.06_DN | AGTCGCGTAGGGGCGGGTC |
| 64 | SPAC13C5.02_UP | AGGAGGATAACGGCACGGGA |
| 65 | SPAC13C5.02_DN | ACTGGGGGTGGTTAATGGCG |
| 66 | SPAC13F5.01c_UP | TCGGAACCCCAASGCAAACA |
| 67 | SPAC13F5.01c_DN | GCCGGCCTAACGCTATCCCA |
| 68 | SPAC13G6.12c_UP | CCACCGCCCATATGTTCCC |
| 69 | SPAC13G6.12c_DN | GCCTCCCGACCATGCACTTT |
| 70 | SPAC13G6.14_UP | ACCAGTGAAACGAAGCCGCG |
| 71 | SPAC13G6.14_DN | CACAACTCGACCGCCCGCTT |
| 72 | SPAC13G7.01c_UP | AAGTTGCGGCCTAGTGGCCT |
| 73 | SPAC13G7.01c_DN | GACGGTGTGGGGGCGAAGGT |
| 74 | SPAC13G7.03_UP | GGGGGCGGGCATCGATTATA |
| 75 | SPAC13G7.03_DN | TTGCGGGGCTGTCGGTGATA |
| 76 | SPAC13G7.07_UP | ATGCAGGTGGAGGGAACGGG |
| 77 | SPAC13G7.07_DN | CGTAACTTTGTGCCCGCGTG |
| 78 | SPAC13G7.11_UP | GAATGGCAGTGGCGGGAAGC |
| 79 | SPAC13G7.11_DN | CGGGACGACAAGGGAGGAGA |
| 80 | SPAC13G7.13_UP | CGTCCCTGCGCAATAAGCTG |
| 81 | SPAC13G7.13_DN | CCAGGTCCCGCTCACTTCCC |
| 82 | SPAC144.08_UP | CTTCCACCGACGGACCAACA |
| 83 | SPAC144.08_DN | TTTTTATGGCCGGGATCGCG |
| 84 | SPAC144.12_UP | CGCGTGGTCTTGTCGGTGAA |
| 85 | SPAC144.12_DN | CGATCCCCTACCAGCCCCGT |
| 86 | SPAC14B6.06_UP | CCTCACGGCATGTGCGTGTT |
| 87 | SPAC14B6.06_DN | GCCCACGTAGCGGATAACCT |
| 88 | SPAC14B6.10_UP | TCCCCGACGCACACGAAGAT |
| 89 | SPAC14B6.10_DN | CCGCAAACAGAAGGCAATCG |
| 90 | SPAC1527.02_UP | TGTCGACGGACTCCTCACGA |
| 91 | SPAC1527.02_DN | CTCCGTAATCGGCGCGAATG |
| 92 | SPAC1556.01c_UP | TGTCGAGTGGGCGCGTTATC |
| 93 | SPAC1556.01c_DN | TCTGTCATAACCGCCGCCGA |
| 94 | SPAC1556.07_UP | ACGACGCGGTAGTAACCGCT |
| 95 | SPAC1556.07_DN | TGAGTCCGGTCGATAGGGGT |
| 96 | SPAC15A10.01_UP | AGCGGAAGGAAGAGGGAGCC |
| 97 | SPAC15A10.01_DN | GGGTGTTTGTCGGGGGCAC |
| 98 | SPAC15A10.16_UP | TCCGCCTCTGCCCACCTGAC |
| 99 | SPAC15A10.16_DN | GACGGTTGCAAGGTGGCTGG |
| 100 | SPAC15E1.07c_UP | AGGGGATCCAGTGCGGCTTT |
| 101 | SPAC15E1.07c_DN | CATCCCCGTACCCACCCCTG |
| 102 | SPAC15F9.03c_UP | GGGATTTCGACGTGGTTGCA |
| 103 | SPAC15F9.03c_DN | GCCCTACCAGATTGCCAGCG |
| 104 | SPAC16.02c_UP | CGACGTCACGCCGATCCTTA |
| 105 | SPAC16.02c_DN | GACGAGTGTGACCGTGCAGA |
| 106 | SPAC1610.01_UP | TGACATAATCGAGGGGCGCG |
| 107 | SPAC1610.01_DN | AAACTGCCGATGCCTGACCG |
| 108 | SPAC1639.02c_UP | TGCGGCGGAATCAGTTAGGG |
| 109 | SPAC1639.02c_DN | CGTATGCGAGCCTCGGAAGGT |
| 110 | SPAC167.02_UP | CACGGGGCAATGGGAGAGACG |
| 111 | SPAC167.02_DN | TGAGCGCGGAGGGAAGAAGG |
| 112 | SPAC167.06c_UP | GTGTTGTTCATGGGCGCGGA |
| 113 | SPAC167.06c_DN | GCTGTGTGAGCTGACGCCAT |
| 114 | SPAC167.08_UP | ACGCGAGGGTTCAAGGCAGA |
| 115 | SPAC167.08_DN | GAACGAAACCGATCGCGCTC |
| 116 | SPAC1687.22c_UP | AGTACCGAGGGAGGCCGGAA |
| 117 | SPAC1687.22c_DN | GGGGGGGAGTGGTGAACGCAG |
| 118 | SPAC16A10.05c_UP | TGCGAGAGTGCCGACGTGAT |
| 119 | SPAC16A10.05c_DN | AATGCGCTGACAGGTCTCGC |
| 120 | SPAC16C9.01c_UP | TGGTGAGCAGGCAGCGATTT |
| 121 | SPAC16C9.01c_DN | TGCGTGAACACGGGCCAGAT |
| 122 | SPAC16C9.07_UP | CGGATTGTTGAACGGTGGGG |
| 123 | SPAC16C9.07_DN | TGCGTGTCTCGCTCGGTTCT |
| 124 | SPAC16E8.02_UP | CACCCAAGCTTCGCCACACC |
| 125 | SPAC16E8.02_DN | CCTCTCCTTCCGCGCGTCTT |
| 126 | SPAC16E8.08_UP | GGGAACCAGCGGGGCGATAG |
| 127 | SPAC16E8.08_DN | ACTTGCTTCCGGGTTCGATG |
| 128 | SPAC1705.03c_UP | CCGTGTGCGAAGCCAGAAAA |
| 129 | SPAC1705.03c_DN | GCGCCTCTGCCACTCCCAAC |
| 130 | SPAC1782.04_UP | GGGCAAAAGGACGTGGGTGG |
| 131 | SPAC1782.04_DN | GCTATCGGTTTTGGGCGGGA |
| 132 | SPAC1783.04c_UP | GGGCGAGTCGAACCTCATCT |
| 133 | SPAC1783.04c_DN | TGCGGCTCACTGGGGATTA |
| 134 | SPAC17A2.14_UP | TACTCCGTTCCCCACCCGCT |
| 135 | SPAC17A2.14_DN | TTAGGGTCGGGGGGTCGGAG |
| 136 | SPAC17A5.08_UP | ATGTGGGCGGGCGTGAACGC |
| 137 | SPAC17A5.08_DN | ACTCCCCACACTCCGCCCTA |
| 138 | SPAC17C9.01c_UP | TGGGATGGAAATTGCAGGGC |
| 139 | SPAC17C9.01c_DN | TATTGCGGGCCTTGCGGTGT |
| 140 | SPAC17C9.03_UP | TGGAGGCAGGTAGGGGTGGA |
| 141 | SPAC17C9.03_DN | ACTTGTTGTTGGCAGCGCGG |
| 142 | SPAC17C9.06_UP | TCCGGATCTGTGCAGCCAGT |
| 143 | SPAC17C9.06_DN | TGGCTAGAGTACGCCGGAAC |
| 144 | SPAC17D4.04_UP | TCTACCGCCACGCTCCCCAT |
| 145 | SPAC17D4.04_DN | GCCGCCTCTTGACTCGCTTG |
| 146 | SPAC17G6.09_UP | GGGGGGGATGCCGCTTAAGA |
| 147 | SPAC17G6.09_DN | CCGCGGGTTCTTCTGGCTTG |
| 148 | SPAC17G6.11c_UP | GGGGTAGCGTTTGGGGATCG |
| 149 | SPAC17G6.11c_DN | CGACATACCACGGCGAATCG |
| 150 | SPAC17G8.06c_UP | TTTTTCTATCACGGCCGCCC |
| 151 | SPAC17G8.06c_DN | CAGCAACATTCACGCCCGC |
| 152 | SPAC17G8.10c_UP | TGACACGCTTAGTCCGCGCC |
| 153 | SPAC17G8.10c_DN | ATCCGCGTAAGGCGTCACCC |
| 154 | SPAC17G8.14c_UP | TCGCATTGTTCGCCTCCCTT |
| 155 | SPAC17G8.14c_DN | ACAAAAGGTGGCGAACGGGGC |
| 156 | SPAC1805.01c_UP | TTGGGCGTTTGGGCGGTACG |
| 157 | SPAC1805.01c_DN | GGGCGCAGTCGGAAATAACC |
| 158 | SPAC1805.03c_UP | TCGGGCGTGCGGACAAAGAG |
| 159 | SPAC1805.03c_DN | CCCCCCCGTACCGCTGAAAA |
| 160 | SPAC1805.13_UP | TCGACAGCAGGACAAGCACGG |
| 161 | SPAC1805.13_DN | CGGTTTGCCGAGGTTTTGGG |
| 162 | SPAC1805.17_UP | TCACGACTACCCCGCCAATG |
| 163 | SPAC1805.17_DN | ATACACTCCGCCCCCCTCGT |
| 164 | SPAC1934.02_UP | TCTCCCCCATACCCCCGCAA |
| 165 | SPAC1934.02_DN | CATCGGGGGATACGCTTAGG |
| 166 | SPAC18B11.05_UP | TGTAACTCCGTCGCGCTGGC |
| 167 | SPAC18B11.05_DN | TTGTGCGGCGTGTTCGTGAT |
| 168 | SPAC18B11.09c_UP | TGGGTGATATGGCGTCCGAT |
| 169 | SPAC18B11.09c_DN | CCAGGCACGCGCAATTATGA |
| 170 | SPAC18B11.11_UP | TTATTCCCCTGAGCGCCACC |
| 171 | SPAC18B11.11_DN | GAGGAAGGGAAGGCGGGGTC |
| 172 | SPAC18G6.06_UP | TAGAAGCATGACCACCGCGC |
| 173 | SPAC18G6.06_DN | TCCTAATCCCCTCACGCTCT |
| 174 | SPAC18G6.09c_UP | CTCCCTCATCCCCAGCCACG |
| 175 | SPAC18G6.09c_DN | TGGAAAAGCCGAGGGACGCC |
| 176 | SPAC18G6.11c_UP | TGGGTTGCGCCTGGTATGCC |
| 177 | SPAC18G6.11c_DN | GGGGGACGCTTATTCGCAAG |
| 178 | SPAC1952.02_UP | ACTCCCGCCTTCGCCACTTG |
| 179 | SPAC1952.02_DN | CAATAGGCACCCGCAGACGC |
| 180 | SPAC1952.17c_UP | GGTGTCCAAGGGCGCAAGTG |
| 181 | SPAC1952.17c_DN | TTCCCCGGCACACCAGGCTAC |
| 182 | SPAC19A8.06_UP | AATTGTCCCGCCCAGCTCT |
| 183 | SPAC19A8.06_DN | TCGGCCAACGGATAAACGCA |
| 184 | SPAC19B12.01_UP | AGGAAGCCAAGCCCGCGTAC |
| 185 | SPAC19B12.01_DN | GTACGCTTAATCTGTCGCCC |
| 186 | SPAC19B12.03_UP | GTCGTACTCGGCCTTTGCGC |
| 187 | SPAC19B12.03_DN | AAAGGCGGGCGGTGAAAAGA |
| 188 | SPAC19G12.07_UP | ATTGCGACGGGACGGAGGTA |
| 189 | SPAC19G12.07c_DN | TCGCGCCGGGTGAATAAGCT |
| 190 | SPAC1A6.01c_UP | GCTGCGGGCGTGTGTTTGTCA |
| 191 | SPAC1A6.01c_DN | GTACACGCTTCACCATCGCA |
| 192 | SPAC1A6.03c_UP | CCGCCCCTGCTTACCTTCCA |
| 193 | SPAC1A6.03c_DN | GGGTCATAGCGATCGGCGGT |
| 194 | SPAC1B3.13_UP | GGACTAAGCGGGGCGGATTT |
| 195 | SPAC1B3.13_DN | GTCCGTTGCTTGTGGGTGCG |
| 196 | SPAC1B9.03c_UP | ACTGTTCGTTCGCTGCCCCC |
| 197 | SPAC1B9.03c_DN | AAGGGTGGAAACGGTGGGGA |
| 198 | SPAC1D4.10_UP | CCTCGGACCCCTAACCCCCT |
| 199 | SPAC1D4.10_DN | GAGGGAACGCCGGTGAGGAT |
| 200 | SPAC1D4.14_UP | GCGGGAACTTGGTGGGGTGA |
| 201 | SPAC1D4.14_DN | CGCGGAAGGGAACACCCATT |
| 202 | SPAC1F7.04_UP | GACCCTCGAAACCTGCTCGC |
| 203 | SPAC1F7.04_DN | ACCGAGGCGTCATTCCCAGC |
| 204 | SPAC1F7.12_UP | ATAAGCATCGAGCGGGCGGA |

| Sequence number | Name | Base sequence |
|---|---|---|
| 409 | SPAC823.12_DN | CGGGAGTCTTGGCGCAATTG |
| 410 | SPAC824.07_UP | AAGCAGGGAGGAGGCCAAGC |
| 411 | SPAC824.07_DN | ATGCTATTGGTCGGGCTGGG |
| 412 | SPAC8E11.01c_UP | CTCCTCGTCGTTGGCGTGCA |
| 413 | SPAC8E11.01c_DN | GCGCAGGGACCGAGATACG |
| 414 | SPAC8F11.06_UP | ATGGACGAGGTGCGAGAGAC |
| 415 | SPAC8F11.06_DN | TCGCCCCACCCCTCGTTATC |
| 416 | SPAC8F11.10c_UP | ACATGCCGTCCTCCGCCTCC |
| 417 | SPAC8F11.10c_DN | GCATTAACCAGGCGCGCAGC |
| 418 | SPAC9E9.09c_UP | GGGGGAAAAGTGGGGCTTCG |
| 419 | SPAC9E9.09c_DN | CACAAGCTCCCCCCACGGCT |
| 420 | SPAC977.05c_UP | TCCCCCCGTCTCGTCATTTC |
| 421 | SPAC977.05c_DN | CGGCCCAATCAGCAGCAAAG |
| 422 | SPAC977.07c_UP | TGCCGACTCAGGCGGAAAAC |
| 423 | SPAC977.07c_DN | TTAACCGGGTCGCACACTCG |
| 424 | SPAC9E9.07c_UP | TCGCGCGGACTCAAATGGAC |
| 425 | SPAC9E9.07c_DN | GCCAACGCCAATCCCGAACTC |
| 426 | SPAC9E9.11_UP | AGATGGGGGGGCTAACCGAA |
| 427 | SPAC9E9.11_DN | TACTGGCCCTTCTTCACCGAC |
| 428 | SPACUNK4.07c_UP | TCTTGTGGCGTTTGCCTCGG |
| 429 | SPACUNK4.07c_DN | CCCACCATCTCGTTCCCTGG |
| 430 | SPAP11E10.01_UP | TGCGGACTAGCCTACGTCAS |
| 431 | SPAP11E10.01_DN | AACCCGTTGATCTCCGGACC |
| 432 | SPAP27G11.03_UP | TCTGAGGGGATGCGTGACAG |
| 433 | SPAP27G11.03_DN | CGACTTTCAGCCCCGACAT |
| 434 | SPAP27G11.05c_UP | CCGAAGCGCCAACCCACAGT |
| 435 | SPAP27G11.05c_DN | ACATTAGGAGCCACGGGGCG |
| 436 | SPAP27G11.07c_UP | TTTCTTTGCCGGTGCGTCGT |
| 437 | SPAP27G11.07c_DN | ATAGTAGCGCGCGCATGAGT |
| 438 | SPAP27G11.09c_UP | CGTCAAGCGAAAGGCCCCAC |
| 439 | SPAP27G11.09c_DN | CCGTCTTAATGGGCGCCGAC |
| 440 | SPAP7G5.02c_UP | CTTGGTGAGCGCGATGTGTC |
| 441 | SPAP7G5.02c_DN | CAGACCCCGACTAGCACGCA |
| 442 | SPAPB3A3.06_UP | CACCCGCCTTCCGTTGTCAG |
| 443 | SPAPB3A3.06_DN | TTCGTCCCCTCCGCTTGTTC |
| 444 | SPAPB21F2.03_UP | TGCGCCCATGCCTCGTAGTC |
| 445 | SPAPB21F2.03_DN | CGCCTACTCTTCGGCTGCCC |
| 446 | SPAPB2B4.02_UP | GCGGGTTCGGATTTTAGGG |
| 447 | SPAPB2B4.02_DN | TCGGGTTGCTGTGAGGGGAG |
| 448 | SPAPB2B4.06_UP | GACACGGCCTAACGCCTCCG |
| 449 | SPAPB2B4.06_DN | CGGTCAGGGAGAAAGAGGCG |
| 450 | SPAPB8E5.09_UP | CTGCACGCCCATACGAACCG |
| 451 | SPAPB8E5.09_DN | CCGTTGCCTTGCTGTACCCC |
| 452 | SPAPYUG7.05_UP | GCCCCCAACAGGAGCAGGAC |
| 453 | SPAPYUG7.05_DN | CTTGGCGGTGCTCTGTGGGG |
| 454 | SPBC106.18_UP | GACCGCGGTGTCCCCTTTG |
| 455 | SPBC106.18_DN | TCTGGGCAACTGGCGGAAGT |
| 456 | SPBC106.20_UP | CCCCGCTTTCATGCACGACC |
| 457 | SPBC106.20_DN | TTTCAACGGCGAGGACGAGA |
| 458 | SPBC119.09c_UP | GTTGTAGGACGGGGCTGGGG |
| 459 | SPBC119.09c_DN | ATACTTGGTTGAGCGGGGGA |
| 460 | SPBC1198.04c_UP | CGCCCGACCTTCATTTACGC |
| 461 | SPBC1198.04c_DN | TTCGCGCCGCCTGATAACCT |
| 462 | SPBC1198.12_UP | AAAGTAGTTCCTGCGCCCGC |
| 463 | SPBC1198.12_DN | CCACCCATGCATCGCCACTT |
| 464 | SPBC1198.14c_UP | ATCGGGTGCCGTCGCTGTCG |
| 465 | SPBC1198.14c_DN | TATGCAGGCGCACAGGCAA |
| 466 | SPBC11C11.04c_UP | AAATGCGGGGTGTGGGACTC |
| 467 | SPBC11C11.04c_DN | GCTACGGTCTGGAGGTCCGG |
| 468 | SPBC11C11.10_UP | AAACCTACGCCGTGTACCGCC |
| 469 | SPBC11C11.10_DN | CTTAAGGGAGGGCGCGAGAA |
| 470 | SPBC11G11.04_UP | CCCCCCACTTCCAGCACTCG |
| 471 | SPBC11G11.04_DN | TTAGTCGCCAGGCCGTCCTC |
| 472 | SPBC11G11.06c_UP | GCGGCCCGGCGTTAGGGACTA |
| 473 | SPBC11G11.06c_DN | GGTACGTCCGGTTGCTCTTC |
| 474 | SPBC1271.13_UP | CGCAACAAACCTGCACGCGA |
| 475 | SPBC1271.13_DN | GTACCGGCCAAGTCAGCGGT |
| 476 | SPBC1289.14_UP | GGGGGCCGTGGGAATAAGAGG |
| 477 | SPBC1289.14_DN | ATGCGGCCGTGTTGATTTGC |
| 478 | SPBC1289.16c_UP | GTTACCGCGGGCTTCTGTGG |
| 479 | SPBC1289.16c_DN | AATGATGGCGGTGGAGGACG |
| 480 | SPBC12C2.06_UP | AGGTCGACAGGAGGGGAGGC |
| 481 | SPBC12C2.06_DN | AAACAATGTCGCACGTCGGG |
| 482 | SPBC12C2.10c_UP | GCCTCAGGCACAACAGACCG |
| 483 | SPBC12C2.10c_DN | CACGTGCGCCCCTCTCCCTT |
| 484 | SPBC12C2.12c_UP | ATCGTAAGGGTTTTTGGGCT |
| 485 | SPBC12C2.12c_DN | CGGTCCAGCCATCCACAAGG |
| 486 | SPBC12D12.01_UP | GGGGCTTAGTGCTGGTGGGA |
| 487 | SPBC12D12.01_DN | GGGTCTGGGGGCGATTACAA |
| 488 | SPBC1306.01c_UP | CGCCGAGAAAAACAGCCAGC |
| 489 | SPBC1306.01c_DN | TGTGGGTTGACGAGCTGGCG |
| 490 | SPBC1347.01c_UP | ACGAATGTGAGTGCCTCCGG |
| 491 | SPBC1347.01c_DN | GCTTGGTGATTGTGGCGGAG |
| 492 | SPBC1347.05c_UP | CTCACGCCCGTTATTTCGCC |
| 493 | SPBC1347.05c_DN | GGGCGGAGGACCGGTACAGA |
| 494 | SPBC1347.07_UP | AACGTGGCGGCGTCGCACCTTA |
| 495 | SPBC1347.07_DN | CCGGATTAACGACCACGCCT |
| 496 | SPBC1348.14c_UP | CGCACAGGTCCCCAGCCAAC |
| 497 | SPBC1348.14c_DN | TCTGCCGCTTCCCAATACCG |
| 498 | SPBC13E7.10c_UP | GCAACCTGGCCTCGACAACG |
| 499 | SPBC13E7.10c_DN | ACGGTCCTGCGAAACTGCCC |
| 500 | SPBC13G1.01c_UP | TTACGGGAGGACGGCAATG |
| 501 | SPBC13G1.01c_DN | AAAGTGGGTCGTGGGGCGAT |
| 502 | SPBC13G1.07_UP | GAGGGGCAACCGAAAGCGAG |
| 503 | SPBC13G1.07_DN | GGTCGAGTGGGGGGCCTTTG |
| 504 | SPBC13G1.11_UP | GATGGGGGTTTAGACGGGGG |
| 505 | SPBC13G1.11_DN | TGTTGGGCGAAGAATGCTGG |
| 506 | SPBC13G1.13_UP | ACATCGATTACCGACCGCC |
| 507 | SPBC13G1.13_DN | GGCGGGGTGAGTTGGTGCTT |
| 508 | SPBC146.01_UP | TAGGGAGCGGGGGGTGAACGA |
| 509 | SPBC146.01_DN | ATATCAGAAGGACCGGCGCG |
| 510 | SPBC146.13c_UP | AAACGCCACCGCATACCCAG |
| 511 | SPBC146.13c_DN | GGTGGCTGGGAGAGA3CGGA |
| 512 | SPBC14C8.01c_UP | GTGACAAATGCTGGGCGCCT |
| 513 | SPBC14C8.01c_DN | TCGTAGATTGACCGCCGCCT |
| 514 | SPBC14C8.07c_UP | ACCGCCCGAAGTGTGCTCAC |
| 515 | SPBC14C8.07c_DN | ACCCCATTTCGCCGGTTCCT |
| 516 | SPBC1539.01c_UP | AGCGAGGGTTGCGGGTGAAA |
| 517 | SPBC1539.01c_DN | TCCCGATTCAACCGGCTCTT |
| 518 | SPBC1539.09c_UP | TCGCCGCACAGCCGTAGACC |
| 519 | SPBC1539.09c_DN | GGGTGAAGGGGTGCCAGCTCG |
| 520 | SPBC15C4.01c_UP | TCGGGGGACCTTGGTTTTAG |
| 521 | SPBC15C4.01c_DN | TAACCAGGCCGGAGCGACAG |
| 522 | SPBC15C4.03_UP | CCGCTCCAACACCCCGACAG |
| 523 | SPBC15C4.03_DN | CTACAACCCTGCACTCCCGC |
| 524 | SPBC15D4.01c_UP | AGCGAGTTAGCCGGGTGGCC |
| 525 | SPBC15D4.01c_DN | TACATCCCGCCACCACCCAC |
| 526 | SPBC15D4.11c_UP | TTTTTGCGCGGCACTGCTCT |
| 527 | SPBC15D4.11c_DN | TCGACAGGCCGGAACAAAGC |
| 528 | SPBC1604.06c_UP | CCGTCGTCGCCATAGTCTGG |
| 529 | SPBC1604.06c_DN | GCTGGCTAACTGCGGTGACG |
| 530 | SPBC1604.09c_UP | CACACGAAAATCTGCCGCTCG |
| 531 | SPBC1604.09c_DN | TCGGACTAGGTGCATTGCCG |
| 532 | SPBC1685.10_UP | CGCCCTGACGAGCAACCACT |
| 533 | SPBC1685.10_DN | ACCGGCGCCCCCATACTCAAG |
| 534 | SPBC18A3.02c_UP | GGAGTTCCCGGTCAGACGTT |
| 535 | SPBC16A3.02c_DN | CGGGTCGTTGCCTGGTCTGG |
| 536 | SPBC16C5.13c_UP | TCCGCAGCTGGGGATCATAC |
| 537 | SPBC16C5.13c_DN | TCAAAACGGACGGCCCAACA |
| 538 | SPBC16E9.01c_UP | AAGGAAGAGGCTGGGGCACG |
| 539 | SPBC16E9.01c_DN | ACGGTCGGCTAGCAGGTTGG |
| 540 | SPBC16E9.16c_UP | TTCCGCCTCGATCCCTTCCA |
| 541 | SPBC16E9.16c_DN | CATCGCTCGCTACGCGATCT |
| 542 | SPBC16E9.18_UP | CGACACTCCAAGCTCCCGGG |
| 543 | SPBC16E9.19_DN | GCCGGTGCCCTCAATTGGAT |
| 544 | SPBC16G5.01_UP | TCGGGCTCAGTGCGTACAAC |
| 545 | SPBC16G5.01_DN | TGCGCTTAGGTCGCAACAT |
| 546 | SPBC16H5.10c_UP | AGGGCTTGAGATTCGGCGGG |
| 547 | SPBC16H5.10c_DN | AGGTGCGCTGTGGGGGAAG |
| 548 | SPBC16H5.12c_UP | GCGGGTGTGGAGTAGCGAGC |
| 549 | SPBC16H5.12c_DN | CCGCGGCACCAAGTAGGAAT |
| 550 | SPBC1703.11_UP | CCGACATAGAGCCGCACCTG |
| 551 | SPBC1703.11_DN | GAAACTCGCTCCGCACCCC |
| 552 | SPBC1703.15c_UP | GGAAAGCTAAAGGGCACGCC |
| 553 | SPBC1703.15c_DN | CTGCGCGGTGTCTTTTGCCT |
| 554 | SPBC1709.C1_UP | TCCTCTGCGGTGGTCGTGTC |
| 555 | SPBC1709.01_DN | CTCAGGGGTAGTGCAGGCGA |
| 556 | SPBC1709.17_UP | GGCGATTCGAAGGGCGAGTT |
| 557 | SPBC1709.17_DN | CTCTGCGCATTAAGCGCCAT |
| 558 | SPBC1709.19c_UP | TTCGGCCCACCACCTATCGA |
| 559 | SPBC1709.19c_DN | GAGGGCGCGCTTGTCACTTT |
| 560 | SPBC1711.14_UP | ACCACCATTCGGACCCATCC |
| 561 | SPBC1711.14_DN | TCAGGCATGGCGTGGGTTTG |
| 562 | SPBC1711.16_UP | AAGTGGGCAGCCGATCATC |
| 563 | SPBC1711.16_DN | CGTCAGGCGAGCACCGGTTA |
| 564 | SPBC1718.05_UP | GCTCCCGCTGATGGTTGCTT |
| 565 | SPBC1718.05_DN | CAGACGAACACCGCCGACCG |
| 566 | SPBC1734.07c_UP | GGGCCGGTCATCTTCTCCT |
| 567 | SPBC1734.02c_DN | AGGCCCGTCCCTCGTAAGGAT |
| 568 | SPBC1734.04_UP | ACGGCCGTCACAGCTGCTTT |
| 569 | SPBC1734.04_DN | CATCCGGGTCGGTAGACGCG |
| 570 | SPBC1734.10c_UP | CTGCCCAACCCTCATCGCGT |
| 571 | SPBC1734.10c_DN | GGATAGGCTCGCAAAACGGG |
| 572 | SPBC1734.16c_UP | CTGATCGCTCGGCGCAAATGA |
| 573 | SPBC1734.16c_DN | CCGGCAGGGGAATGATGAAG |
| 574 | SPBC1778.01c_UP | TCATTACCGTCGTGCCCCCG |
| 575 | SPBC1778.01c_DN | GTCATGGTGTGCGGGGCTGT |
| 576 | SPBC17A3.01c_UP | ACCGTGCGAACGGAACAGTC |
| 577 | SPBC17A3.01c_DN | AAAATCAAGGCACGGGGACG |
| 578 | SPBC17A3.05c_UP | CGCTTCACAACCCCCAGTCC |
| 579 | SPBC17A3.05c_DN | GTTGTTTGCATGCCTCCGGA |
| 580 | SPBC17A3.09c_UP | CTGCCTCGTTCGTCGCCTTG |
| 581 | SPBC17A3.09c_DN | TTGTTACTCGTCCGGCCCTG |
| 582 | SPBC1701.01_UP | CGCACAAGTATCGCCCCGAT |
| 583 | SPBC17D1.01_DN | CCTTGCTCCATCGCCCTTCG |
| 584 | SPBC1815.01_UP | CGCGGCCGTGGTCATGTTTA |
| 585 | SPBC1815.01_DN | GCGATGGGTTGGTGGCCTTG |
| 586 | SPBC1861.01c_UP | AGAGTGGGGGGAAAGTGGCG |
| 587 | SPBC1861.01c_DN | TCGAATAGGGAAGCAGCGCA |
| 588 | SPBC18E5.02c_UP | TGCGGCGTGGCTTGCTTACA |
| 589 | SPBC18E5.02c_DN | ACGAAACCGGTATGGGGCAG |
| 590 | SPBC18E5.12c_UP | GGCTCCCGCACTCATAACCG |
| 591 | SPBC18E5.12c_DN | ACCCCCCCCAAGTTTAGTCGG |
| 592 | SPBC18H10.17c_UP | GCGCACCGTTCCCATGTTTG |
| 593 | SPBC18H10.17c_DN | GCCCCGCAAAAAAAAGCACA |
| 594 | SPBC1921.02_UP | ACGGCACGCGGAGAGAGAGA |
| 595 | SPBC1921.02_DN | GGACTAATGCACCCGGCCTC |
| 596 | SPBC19C2.01_UP | CCGGACGCCTTCGCACCCTTA |
| 597 | SPBC19C2.01_DN | CTTGCCGGTGTTCTCGGACG |
| 598 | SPBC19C2.07_UP | CCCCACACCGACTTGCACCA |
| 599 | SPBC19C2.07_DN | CCCCCCTGCGGAAGTACGTC |
| 600 | SPBC19C2.11c_UP | CAGTGGGGCTTTAGGCGTCG |
| 601 | SPBC19C2.11c_DN | TGCTTTCTCTCCGGGGCGTC |
| 602 | SPBC19C2.15c_UP | TGGCGGGTTGGTGCATTTTG |
| 603 | SPBC19C2.15c_DN | AGCGGAGCGGACACATAGGG |
| 604 | SPBC19C7.02_UP | GGCTTAGCCGCTTCCAGCCCG |
| 605 | SPBC19C7.02_DN | GCTGGATCGGAGGGGACTTG |
| 606 | SPBC19F8.01c_UP | AGGTCGGACTGGTCCTGACT |
| 607 | SPBC19F8.01c_DN | TGCTGCACCCTTAACGAGGT |
| 608 | SPBC19F8.05_UP | AACTTTGAACCACCCGCGCA |
| 609 | SPBC19F8.05_DN | CGTTAGGGCGGGATTCGAGG |
| 610 | SPBC19G7.01c_UP | GTGTCTTCGATTTGCGCGGG |
| 611 | SPBC19G7.01c_DN | AACAGTAGCAGCGCAGCCCA |
| 612 | SPBC1A4.01_UP | ACCGCCAAGCTGCACGAAAC |

FIG. 10

| Sequence number | Name | Base sequence |
|---|---|---|
| 613 | SPBC1A4.01_DN | CTGCGCATTTCCGTCCTTCA |
| 614 | SPBC1A4.10c_UP | CACTCGACCACACCGCTCCC |
| 615 | SPBC1A4.10c_DN | GGGGCTGGAACGTGATGGAA |
| 616 | SPBC2CF10.04c_UP | GTGTTTCGACGGGCCTCCAC |
| 617 | SPBC2CF10.04c_DN | TTCGTTCTCAGCTTCCCGCC |
| 618 | SPBC211.01_UP | CCGTGGTGTTCGGCCTCTCG |
| 619 | SPBC211.01_DN | AACTTGCCCCCACCAACTCG |
| 620 | SPBC215.12_UP | CGGGGCGGACATTTGAGTGG |
| 621 | SPBC215.12_DN | GATTAAACCGGCTCCGCCCG |
| 622 | SPBC21B10.08c_UP | GCCGCTTCCGATTACCCCAC |
| 623 | SPBC21B10.08c_DN | ACAAATCACCCCAGCGCCCA |
| 624 | SPBC21C3.01c_UP | AGGGCCAGCAGGTACCGCAA |
| 625 | SPBC21C3.01c_DN | CAAACGTGGGGCAAAACGGG |
| 626 | SPBC21C3.05_UP | ATACCACATCGCACGGCTCGG |
| 627 | SPBC21C3.05_DN | CATCCCGCCACAAATCGCTC |
| 628 | SPBC21D10.08c_UP | CTCCCGAGCTTAAGCGGTCT |
| 629 | SPBC21D10.08c_DN | GGAGGACACGGGGATGGGGT |
| 630 | SPBC23E6.06c_UP | CCGGTCGCGCGATGCTAGAAT |
| 631 | SPBC23E6.06c_DN | TTGCTTACGGTCGGGCTTGC |
| 632 | SPBC23G7.05_UP | GGACGCTCACACGTCCTTGT |
| 633 | SPBC23G7.05_DN | TGTAACGTACCGTCGCGAGC |
| 634 | SPBC23G7.12c_UP | AGGTCGGTGGGGGCAGTGTG |
| 635 | SPBC23G7.12c_DN | GCAGGGTAGGGCGGGGATTC |
| 636 | SPBC23G7.16_UP | TGTTGGGTGCGTGTGGTCA |
| 637 | SPBC23G7.16_DN | CACCACCCCATTCGCCGTTC |
| 638 | SPBC244.02c_UP | AACCCCCAGACACCGCCGAC |
| 639 | SPBC244.02c_DN | CCGTTGGATTGTTTGCAGGA |
| 640 | SPBC24C6.05_UP | GCAAGAAGCGCGGGGTACAT |
| 641 | SPBC24C6.05_DN | TGAGGATGAGGTACGGAGCA |
| 642 | SPBC25B2.02c_UP | CCGCCGTAACGACGAATGGC |
| 643 | SPBC25B2.02c_DN | GACGGCTTACGGGGTCCTGG |
| 644 | SPBC25D12.04_UP | TTTCCTCCTATACGCGCGCC |
| 645 | SPBC25D12.04_DN | CACCTAGACCCTGCCTCGCG |
| 646 | SPBC27.08c_UP | ACGAGCAAAATGGGCCGACC |
| 647 | SPBC27.08c_DN | GCCCGCGCCGTAGTTGTGAC |
| 648 | SPBC27B12.02_UP | AATGGCCTCGGGCTGGGAAC |
| 649 | SPBC27B12.02_DN | TAGGGGCGGGGATCAGCGTC |
| 650 | SPBC27B12.04c_UP | CGCGACTCTCAGAGGGACT |
| 651 | SPBC27B12.04c_DN | TCGACTGGTCAGGGACTGGA |
| 652 | SPBC27B12.12c_UP | AGCGGAAAGAGAAGAACCGG |
| 653 | SPBC27B12.12c_DN | GCGTTCTGCCTCTGGTCTCCC |
| 654 | SPBC28E12.02_UP | TCTGGGTATGGTGTTCCGGGG |
| 655 | SPBC28E12.02_DN | TCAGGGGGACGTTGTGGCTC |
| 656 | SPBC28E12.06c_UP | ACACCGCACCATCTCACCGC |
| 657 | SPBC28E12.06c_DN | AATTCCTTTTCGCGGCTGGC |
| 658 | SPBC29F2.09_UP | TCGCTGGGCCGTTGTTCTGT |
| 659 | SPBC28K2.09_DN | GGCAAAGGATGCAGGGCCTA |
| 660 | SPBC29A10.01_UP | TGGGCCGTCGGGTTCCAATAA |
| 661 | SPBC29A10.01_DN | AATGGCAATCGCACGGTGGT |
| 662 | SPBC29A10.03c_UP | GGAAGGCATGGCTGGAAGGA |
| 663 | SPBC29A10.03c_DN | GGTCGTCGTCTCGGGCTCTT |
| 664 | SPBC2A9.09_UP | CCGAACCCCTTATGCCACCC |
| 665 | SPBC2A9.09_DN | TACAACTGCCTCCCCCACCC |
| 666 | SPBC2A9.11c_UP | CTGACCGCGGCCTAACTCCT |
| 667 | SPBC2A9.11c_DN | CAGATTGGCAGTGGGACCGA |
| 668 | SPBC2D10.16_UP | CTTCTCCTTTTCCGCGCCCA |
| 669 | SPBC2D10.16_DN | GCATCATCGAAAGCAGGGGG |
| 670 | SPBC2D10.20_UP | AATTGTTTAGCGCCGGCCGA |
| 671 | SPBC2D10.20_DN | CCGAACCGCACTGCACGTGA |
| 672 | SPBC2G2.01c_UP | CGCAACGGACTGGGGATCAT |
| 673 | SPBC2G2.01c_DN | TCCCCCCGCCGGTGTGCTTAAC |
| 674 | SPBC2G2.05_UP | GACTCCGGCTTCGCTTGCGG |
| 675 | SPBC2G2.05_DN | CCCAAGCCCTGATTCGCCTG |
| 676 | SPBC30B4.01c_UP | TGTTTCCCTGGCGCTTCGTC |
| 677 | SPBC30B4.01c_DN | GAAGCCGATGGGGAGACCGA |
| 678 | SPBC30D10.06_UP | CGTCTCACTCCGGCCTTGCG |
| 679 | SPBC30D10.06_DN | TCCCATCACCACGTCCAGCG |
| 680 | SPBC31A8.01c_UP | TTTTGATTCGCGGACGCTGG |
| 681 | SPBC31A8.01c_DN | CCTGGCCCTGCTTCGTAACG |
| 682 | SPBC31E1.04_UP | GCCCCTCGCTGTTACTCGT |
| 683 | SPBC31E1.04_DN | CGGGTGGGCGCAATGAAGAG |
| 684 | SPBC31E1.06_UP | GCGGAAGATAGCGGCGATGC |
| 685 | SPBC31E1.06_DN | TCTGGTTGCGTGGCGTGATT |
| 686 | SPBC31F10.05_UP | GGTTTTCGACGCCTGCCTTG |
| 687 | SPBC31F10.05_DN | TCGGCGAGCATTAAGGGGT |
| 688 | SPBC31F10.11c_UP | CTCCGCACGCAACACCAACG |
| 689 | SPBC31F10.11c_DN | ACAGGCAACCAACCAAGCGC |
| 690 | SPBC32F12.10_UP | TTACGTAGGAGTCGGCGCG |
| 691 | SPBC32F12.10_DN | CGAACTGCGCACCCACCACT |
| 692 | SPBC336.09c_UP | TGCAGTGGGTCCTTTCGTGG |
| 693 | SPBC336.09c_DN | GCACGGCAATAACGACCCC |
| 694 | SPBC336.11_UP | CAAAAAGCAACCAGTCGGCG |
| 695 | SPBC336.11_DN | CGAATTCCCCGCGCGATAACT |
| 696 | SPBC336.15_UP | AGGATGGGGGATTTTCGAG |
| 697 | SPBC336.15_DN | ACCCGCGGCCTGCTACAAAT |
| 698 | SPBC337.09_UP | ACCCATGACGGACTCCCCTA |
| 699 | SPBC337.09_DN | ATGGGTCCCGTCACGCTTCA |
| 700 | SPBC337.13c_UP | AAACATTACTAGGCGCCGGG |
| 701 | SPBC337.13c_DN | CATCGTTACTAGGCGCCGGG |
| 702 | SPBC342.01c_UP | CGCCTGCCGCTCTCCGACTA |
| 703 | SPBC342.01c_DN | CGCCCTCCTACCCCACGCTA |
| 704 | SPBC354.01_UP | TCAGCGGCCCAACCCTAGTCC |
| 705 | SPBC354.01_DN | GGGAATCAGGCGCGCGGACA |
| 706 | SPBC36.08c_UP | TTGGGGTTCTCCTTGGCCTG |
| 707 | SPBC36.08c_DN | TGGCGCGGGGGATCTGTAGT |
| 708 | SPBC36.12c_UP | CGCTCCCTCACACATCCACG |
| 709 | SPBC36.12c_DN | TGGCCGTGTGTCTTTCCTCG |
| 710 | SPBC365.13c_UP | CTGCGGCGCAACAGAGGTGGT |
| 711 | SPBC365.13c_DN | CGCCACGCGAGGTAACCAC |
| 712 | SPBC365.15_UP | AGCCCTCTGACCTGCACCTT |
| 713 | SPBC365.15_DN | ATTGTACGTGTGCTGCGGCG |
| 714 | SPBC3637.07_UP | CGCACGCCTACCAACGCT |
| 715 | SPBC36B7.07_DN | GAACAGACCGGTGGGCGAGG |
| 716 | SPBC36B7.09_UP | TGTTTCGGGATCTGCTGGCA |
| 717 | SPBC36B7.09_DN | CGCCGCGCAAITATGTTACG |
| 718 | SPBC3B9.03_UP | AAACGGTGCCAGGCCAGGAA |
| 719 | SPBC3B9.03_DN | TACGTGCGAGCTGCCACTA |
| 720 | SPBC3B9.13c_UP | ACAAAAGACGGCGGAGGGA |
| 721 | SPBC3B9.13c_DN | AGCCCCCCACCGAACCATTG |
| 722 | SPBC3D6.15_UP | ACTGTGATTTCGGGGGCGT |
| 723 | SPBC3D6.15_DN | TGTTATCCGAGGGTGCCGCC |
| 724 | SPBC3E7.13c_UP | ATGGGGGCTGCTTACCGTGT |
| 725 | SPBC3E7.13c_DN | CCTGTTTCTCGCGTGGTCGG |
| 726 | SPBC3E7.15c_UP | CCCCCGTAAGCATGGGGCAA |
| 727 | SPBC3E7.15c_DN | GCGGTCGAAATGGTCAGGGC |
| 728 | SPBC3H7.11_UP | ACGGGGTCACTGGGGGCTGT |
| 729 | SPBC3H7.11_DN | ACAGCAASGGTGGGTCAGCG |
| 730 | SPBC405.01_UP | TCGCAGCTGGGGAACACTAG |
| 731 | SPBC405.01_DN | CCCGCCCGTAAAGTTGCAGC |
| 732 | SPBC409.04c_UP | GCCCAACGCAGAGCCCATCA |
| 733 | SPBC409.04c_DN | CACCCATACGCAACGGCCAA |
| 734 | SPBC409.12c_UP | GTGTTTTCATCCCCCCCCAT |
| 735 | SPBC409.12c_DN | AAATGCGATGAGGCGACGA |
| 736 | SPBC418.01c_UP | AAATTATCGGGCGGGGGTCC |
| 737 | SPBC418.01c_DN | GCGGGGGACAAAATCAGCTC |
| 738 | SPBC428.01c_UP | TGCACGCCTCTGATTTCCCG |
| 739 | SPBC428.01c_DN | GGAATGGTGGCAGGAAGGGG |
| 740 | SPBC428.15c_UP | GAGTTGTTCCCGTGCGCTTG |
| 741 | SPBC428.16c_DN | CGAATGGGGGTGCTGTTGG |
| 742 | SPBC428.20c_UP | CACTTTTCCGGCGACTTGGC |
| 743 | SPBC428.20c_DN | GCACCGCAGAACCCAACCAG |
| 744 | SPBC4C3.10c_UP | AAAATCCGCCCCCCATCAAA |
| 745 | SPBC4C3.10c_DN | GCACACTGACGAACCGCCGA |
| 746 | SPBC530.12c_UP | TCATAAGCCGGAAGCGGCCA |
| 747 | SPBC530.12c_DN | GCTCCAGCCGCACTTTTCGA |
| 748 | SPBC557.03c_UP | CCAACCCGCCATCAGCAAAA |
| 749 | SPBC557.03c_DN | CGTCCCTCCTGACAGGCCAT |
| 750 | SPBC577.02_UP | CGGTGAAGGGGAATGCGAAC |
| 751 | SPBC577.02_DN | TGTGGCGGCATGGTCGATAT |
| 752 | SPBC577.04_UP | CGACCTGCCTACCCGCTCCC |
| 753 | SPBC577.04_DN | GCTTTGGCCTCGGTTGCTGT |
| 754 | SPBC582.07c_UP | CGTTACCCGCATCCAGCAAA |
| 755 | SPBC5E2.07c_DN | GCGCCAATTAGACGCACCCC |
| 756 | SPBC646.05c_UP | GACGGTGTGGGGCGAAGGTG |
| 757 | SPBC646.05c_DN | ACAGCTTCGCACAGGGCAGT |
| 758 | SPBC646.07c_UP | GTCGGTTAAGCGGCGGTGTG |
| 759 | SPBC646.07c_DN | CGACACGCCTCACGAACGAC |
| 760 | SPBC646.11_UP | GCGCGGCCCCTCAACCTTAT |
| 761 | SPBC646.11_DN | ACCGGGTCACCTACCCTCAA |
| 762 | SPBC646.17c_UP | GGACACCCAGCCGTCGACCAA |
| 763 | SPBC646.17c_DN | TTCGACCGGCAGCCTTGTTT |
| 764 | SPBC660.16_UP | GCCAGCCAACCCATCACCCT |
| 765 | SPBC660.16_DN | AGGGTGGCGCATAACGGAGT |
| 766 | SPBC691.04_UP | TAGCCGCGCCCATTGAGAAC |
| 767 | SPBC691.04_DN | ATCCCACCCCGCTAGTTGCA |
| 768 | SPBC725.09c_UP | GGCGCAGCTCAAACCACCGA |
| 769 | SPBC725.09c_DN | TCGACAGGGGCCAGAAGACG |
| 770 | SPBC725.13c_UP | AGCGTTAGTGCGTTGGCGAA |
| 771 | SPBC725.13c_DN | TGGCGCGAAAGGGATGGTTG |
| 772 | SPBC725.17c_UP | GTGCTTGGGGGATGCGCTTA |
| 773 | SPBC725.17c_DN | CTCCCGTGCGCCTTGACCTC |
| 774 | SPBC776.10c_UP | TCACGTGTTTGGGGCAGAGG |
| 775 | SPBC776.10c_DN | CCCGGCGCCTTCGTTCGTAATC |
| 776 | SPBC776.12c_UP | GAAACAAGGTGCCCGGATCA |
| 777 | SPBC776.12c_DN | TTCCCGGCAAAAACACCCAR |
| 778 | SPBC83.04_UP | CGCTTTGGTCGCCCTCTCAG |
| 779 | SPBC83.04_DN | ATTCTATCGATCGCGCCGGG |
| 780 | SPBC83.14c_UP | GATGGGTGGCGGGTGATTCT |
| 781 | SPBC83.14c_DN | GGGTATGGGGGTGTCTCGGG |
| 782 | SPBC839.10_UP | GCGGGGAGGGGAGACAAGAC |
| 783 | SPBC839.10_DN | CAAACGCCGGAATCAAGCCC |
| 784 | SPBC839.12_UP | GGCCTTCATGCTACCLCTGG |
| 785 | SPBC839.12_DN | TGTGATTGGTTGTCGGGGCG |
| 786 | SPBC839.14c_UP | CGAGGCCGACTAAGTGCTGA |
| 787 | SPBC839.14c_DN | TCTCTCACGGGTGGCCAGAA |
| 788 | SPBC887.03c_UP | TAGGCCCCAATCAAACCCC |
| 789 | SPBC887.03c_DN | ACATCATCATCCGCCCGCTCA |
| 790 | SPBC887.09c_UP | AGACTTCCCCCTTCCGCCCC |
| 791 | SPBC887.09c_DN | TTAGCCCAACCCGCCCGATT |
| 792 | SPBC887.13c_UP | TGGAAGGGGACTAACGCGGG |
| 793 | SPBC887.13c_DN | ACACACGCCGAGAACCACGA |
| 794 | SPBC8D2.02c_UP | CGGGCGATGAGGGGAAGTAC |
| 795 | SPBC8D2.02c_DN | GCTTGCGTTGCGCTGTCCTA |
| 796 | SPBC8D2.04_UP | CCGCGTTGTTTGGTTGCCGT |
| 797 | SPBC8D2.04_DN | CGTGGCAAGGGAACAGGGCA |
| 798 | SPBC8D2.06_UP | ATCGTGCCTTTCGCCTCCAA |
| 799 | SPBC8D2.06_DN | ATGCGAGACGGGGTTGGAAAG |
| 800 | SPBC8D2.11_UP | AATTACCTCCCCACCCAGA |
| 801 | SPBC8D2.11_DN | AAGTTGGTTCGCCGTCGGTCGG |
| 802 | SPBC8D2.13_UP | ACGGGACGGGGCGAGTTACG |
| 803 | SPBC8D2.13_DN | CGCTACGGGCTTGCAAACAG |
| 804 | SPBC8D2.15_UP | CCGCCGCACATCCAAAGCTA |
| 805 | SPBC8D2.15_DN | TTCCAAAATCCAACGTCGCC |
| 806 | SPBC8E4.01c_UP | GCTGGAAACTGCGGGAGGGT |
| 807 | SPBC8E4.01c_DN | GCGGCTGAGTGGGTCTCTCC |
| 808 | SPBC9B6.05c_UP | CCCCTTCCACGCCTACGTCCC |
| 809 | SPBC9B6.05c_DN | CGGAGACGAAACGCGCAACA |
| 810 | SPBP1SF5.02_UP | AGCTTCAGCCGGGAACGTAG |
| 811 | SPBP15F5.02_DN | GTGGGCGGAGATGAGTCGAA |
| 812 | SPBP19A11.07c_UP | CACCGCCCGTCCAAACACTT |
| 813 | SPBP19A11.07c_DN | GAGGGGTAAFCGCGCCAACG |
| 814 | SPBP22H7.03_UP | AGCTCTTCTGACGGGGCCAC |
| 815 | SPBP22H7.03_DN | CCCCGTCGCATGGAATTTGA |
| 816 | SPBP22H7.08_UP | TGGCGCAAGGAGCTGTATCG |

FIG.11

| Sequence number | Name | Base sequence |
|---|---|---|
| 817 | SPEB22H7.08_DN | CCGTCCCCGCAGCATACATA |
| 818 | SPEB23A10.04_UP | GGAAAATGGTGGCTGCTGCG |
| 819 | SPEB23A10.04_DN | CCCTCTGCGCCCTTCATCCA |
| 820 | SPEB4H10.06a_UP | TCGTTGAGCACCCCAGCCTT |
| 821 | SPEB4H10.06a_DN | ATGCTTAGGGTCCGGTGCGG |
| 822 | SPEB4H10.08_UP | CGCGCATACACGGACAAGGT |
| 823 | SPEB4H10.08_DN | CCTGCAGCGGCCTATCCACCC |
| 824 | SPEB4H10.12_UP | TTCGTGCCGTGCTGTATGGG |
| 825 | SPEB4H10.12_DN | ATTGCAACTGGGTGGGGGCT |
| 826 | SPEB9B7.01c_UP | AAGGCCGTGGGGGAATGTTT |
| 827 | SPEB9B7.01c_DN | CAACCACACCCAAGCCCCCA |
| 828 | SPEB9B7.03c_UP | ACCTTGCCGCGTTACAGCGCC |
| 829 | SPEB9B7.03c_DN | TATCTCACCACGCCGCCAGC |
| 830 | SPEB9B7.29_UP | GTCCCGTCCCATTCGTCCCT |
| 831 | SPEB9B7.29_DN | GAGTTTCCTGTCCCGTGCGC |
| 832 | SPEB9B7.31_UP | AAATGGGGGGAGCGTCAGGTG |
| 833 | SPEB9B7.31_DN | GCTGTTTCGCTTGCCGCCAT |
| 834 | SPCC1020.01c_UP | CGCCTCACCTCTCCACCACC |
| 835 | SPCC1320.01c_DN | AGCAAGCAGTCGGGGAGGCAC |
| 836 | SPCC1320.13c_UP | CGCACCGAGAGCACGACAGT |
| 837 | SPCC1320.13c_DN | GGGGTCCGGCTGTTGATGTG |
| 838 | SPCC10H11.01_UP | CTGCGCAAACGACCCCACATG |
| 839 | SPCC10H11.01_DN | GAGGGGCGTGCATAGCCATTG |
| 840 | SPCC1183.01_UP | CCACGGCTCTCCCTCCACCAA |
| 841 | SPCC1183.01_DN | AGCTACTGGCCGAGCGAAGT |
| 842 | SPCC1183.03c_UP | ACCACCCGCCARAACAGTCC |
| 843 | SPCC1183.03c_DN | AGGGTCAGCGGAAGCAAGGG |
| 844 | SPCC1183.05c_UP | CGCCGCCTGGGTCATGTATT |
| 845 | SPCC1183.05c_DN | CAACAGTGCGTCGAAACCGA |
| 846 | SPCC1183.11_UP | CGCCGAGCGTAGCCCGAAGTT |
| 847 | SPCC1183.11_DN | TGGGGTCGAAGAGCGAGGCA |
| 848 | SPCC11E10.02c_UP | AATCGGACACCAGGCACCCA |
| 849 | SPCC11E10.02c_DN | GGGCATGGGTGGAGAGCAGT |
| 850 | SPCC1223.01_UP | CCGACTCCCCAAAGCCCTGC |
| 851 | SPCC1223.01_DN | TGCTCGTTCGTCTGTGCCTG |
| 852 | SPCC1235.02_UP | CCAGCTCGCCTCCCCCTTCTT |
| 853 | SPCC1235.02_DN | ATACTTCTCGCCGGCGCCCTG |
| 854 | SPCC1235.08c_UP | TTGGTTTGCTCCCTCCTCGA |
| 855 | SPCC1235.08c_DN | GGAGCATTCCCGTTGCACAA |
| 856 | SPCC1259.01c_UP | AGTCGCCATGAGCCCTTCGGT |
| 857 | SPCC1259.01c_DN | AGCGCCCGAAAACTGCACGT |
| 858 | SPCC126.14_UP | TGGACGAAGCGAAAGGGGAG |
| 859 | SPCC126.14_DN | TTGTCGCGCGCGTTATCTCCA |
| 860 | SPCC1281.01_UP | ATGACACTCGCGATAGGCCC |
| 861 | SPCC1281.01_DN | GAGGGGGGCGATTTTCTTCC |
| 862 | SPCC132.01c_UP | GGCCTCCTGCAGTTATCCCG |
| 863 | SPCC132.01c_DN | TGGTATTCTTCTCCGTGCCCG |
| 864 | SPCC1393.04_UP | AGGGACGGAGGCCAGGATAG |
| 865 | SPCC1393.04_DN | AGACGGGCCAGCATTCACGG |
| 866 | SPCC1393.06c_UP | GTCAGGGATTGTCGGTGCGC |
| 867 | SPCC1393.06c_DN | AGAGTGGGCAAAAACGGGGC |
| 868 | SPCC1393.08_UP | GCCATTTCTCGGGGGCTACA |
| 869 | SPCC1393.08_DN | ACGCCAGCCTCTTGCGTCTG |
| 870 | SPCC1442.01_UP | ATTGCAGCTCCGCGGACTA |
| 871 | SPCC1442.01_DN | GCCTATGAGCCTACGGCGAA |
| 872 | SPCC1442.03_UP | CAGCAAACTCCAGGCGGTGG |
| 873 | SPCC1442.03_DN | GCAGCAGCCTTCACCXAGT |
| 874 | SPCC1442.17c_UP | TCCATAACGCAGAAAACGCC |
| 875 | SPCC1442.17c_DN | AGCCCAAACACCACCGCAA |
| 876 | SPCC1450.02_UP | TGTCGCGCCGATTCAAACGT |
| 877 | SPCC1450.02_DN | TTGTTCCGGCCCCTCGTTCA |
| 878 | SPCC1494.10_UP | TCCAGTCCGACACATACGGC |
| 879 | SPCC1494.10_DN | GAGCGCCGGGTATCCAATGC |
| 880 | SPCC14G10.01_UP | CCAGCTACTTTTCTTGCCCC |
| 881 | SPCC14G10.01_DN | ACCCGGCCACCTAGCCATCAA |
| 882 | SPCC14G10.03c_UP | GCGGCGAGCTCAGACCTAAT |
| 883 | SPCC14G10.03c_DN | AGTAAGGCCGACGGACAGTG |
| 884 | SPCC162.08c_UP | TCTGCCTTGGGCTGTCGGA |
| 885 | SPCC162.08c_DN | AAGGAGGCACAGGGAGCGGA |
| 886 | SPCC162.12_UP | CGAACACATCCCGACGCAAC |
| 887 | SPCC162.12_DN | TCCGCGTTGCCCTTTTTCTG |
| 888 | SPCC1620.14c_UP | ACACCAGCCCCCCCTCTCTG |
| 889 | SPCC1620.14c_DN | AGATTCGCACCGACCCCACG |
| 890 | SPCC1672.04c_UP | TCAACCCGTGTACTGAGCCC |
| 891 | SPCC1672.04c_DN | GTGTTCTACGCGAGTGCGGT |
| 892 | SPCC1682.07_UP | GGGTTCAGATGTTTGCGGGG |
| 893 | SPCC1682.07_DN | CCTCATCCCCGTTCTGCTG |
| 894 | SPCC1682.11c_UP | GCCGTTCATGCTTTGTGCCC |
| 895 | SPCC1682.11c_DN | CTGGGTGGACACCGTGTGAT |
| 896 | SPCC16A11.05c_UP | ACAAATGGTGCGGTGGTGG |
| 897 | SPCC16A11.05c_DN | GCTGGGGTTCGAGGTGCTTC |
| 898 | SPCC16A11.09c_UP | CTCTTCGCCACCACGGCACCCT |
| 899 | SPCC16A11.09c_DN | GGGGTTCGACTGATGCGCG |
| 900 | SPCC16A11.13_UP | CCTTAACGCGCTTTTGTCG |
| 901 | SPCC16A11.13_DN | GCCTCCAGGACGTCAACTCA |
| 902 | SPCC16A11.17_UP | TCTGCGGCATCCGGCTTGAC |
| 903 | SPCC16A11.17_DN | CGGAACGGGCTGCGGTCTTA |
| 904 | SPCC16C4.04_UP | ATGATGCXXXTTATCCCTGC |
| 905 | SPCC16C4.04_DN | TCACACATTCCCCTTCGCCA |
| 906 | SPCC1795.01c_UP | TCCCACCAAGCGATCCACCA |
| 907 | SPCC1795.01c_DN | AGCGGGACTAGGGTGGGCAT |
| 908 | SPCC18.01_UP | GCTTTCGACCGTGGTAGCCA |
| 909 | SPCC18.01_DN | TAGCGTGAGATCGCGGACAC |
| 910 | SPCC18.13_UP | GTGAATCGCGGAAACCCCGC |
| 911 | SPCC18.13_DN | GCGGTTTATGCTTTGTGCCC |
| 912 | SPCC18.15_UP | TGACCTCCCCTTTGCACCGG |
| 913 | SPCC18.15_DN | CTTAGACGTCGGCCGAGTGA |
| 914 | SPCC1827.01c_UP | CCCCGCTAGTCCCGTTCTC |
| 915 | SPCC1827.01c_DN | ATGACCGGAAGAGGCCCCAC |
| 916 | SPCC1827.07c_UP | TGTCCGGCAGGGTTTGGCT |
| 917 | SPCC1827.07c_DN | GTCCGTCTGTCCGCAAAGGGG |
| 918 | SPCC1840.01c_UP | GTGCAGCCTAGGGTGTTCCT |

| Sequence number | Name | Base sequence |
|---|---|---|
| 919 | SPCC1840.01c_DN | TCTACGGCATCCGTGGACCT |
| 920 | SPCC1840.03_UP | CACCTGGCCGATCGTTTCC |
| 921 | SPCC1840.03_DN | TGGCCACTACCCGGAAAACT |
| 922 | SPCC1840.11_UP | CCCAATACGCCTGCCATCGC |
| 923 | SPCC1840.11_DN | GTGGGGCGAGCGTGTTGAG |
| 924 | SPCC186.04c_UP | GATCTCGCCGCCTACAACCG |
| 925 | SPCC186.04c_DN | ACGATCCCAGCTGCACACCA |
| 926 | SPCC188.11_UP | GCAGGCTAGGTGCAGCCTTA |
| 927 | SPCC188.11_DN | CCGTCACCCTTGCTCCACC |
| 928 | SPCC188.13c_UP | GAAGCGCGGGATTGTATGT |
| 929 | SPCC188.13c_DN | CGGGTTTGGTTGGCGTCATT |
| 930 | SPCC1884.02_UP | GTGGGGCTTGGAACAAACG |
| 931 | SPCC1884.02_DN | CGCACAGCCCCACTAGAAAC |
| 932 | SPCC1902.01_UP | ATAAGGGGCAGAGGGGCAGG |
| 933 | SPCC1902.01_DN | TACGCCCGAGCGATGCAAA |
| 934 | SPCC191.11_UP | GCTCCATGCTACCCGAAAAC |
| 935 | SPCC191.11_DN | TGTGSTTTGTGGGCTCGGAT |
| 936 | SPCC23B6.01c_UP | GACGACAACCGGCACCACGAA |
| 937 | SPCC23B6.01c_DN | CTAATGGCGTACGGCGGGAT |
| 938 | SPCC24B10.11c_UP | CGGGGGTGGGTTTGAAGGGA |
| 939 | SPCC24B10.11c_DN | CGAAACCACCCACGAAGGCG |
| 940 | SPCC285.08_UP | CGACAATTCCCCAGCCCCAG |
| 941 | SPCC285.08_DN | TCCCACCCAGCGTCGTCGTTT |
| 942 | SPCC285.10c_UP | CGGGGAAACGCTCTGGAATGA |
| 943 | SPCC285.10c_DN | ATTGCCGTGAAGATGCCCGG |
| 944 | SPCC297.03_UP | CCAAAATGGCGTCCGGGCTA |
| 945 | SPCC297.03_DN | CAACCGCCCCAGACCATTTT |
| 946 | SPCC2H8.04_UP | CTTGAATCCTTCCGCACCGA |
| 947 | SPCC2H8.04_DN | ATCACTCCGCCCAGCATTCC |
| 948 | SPCC31H12.06_UP | CAAAAGCGAAAACCGGGCAG |
| 949 | SPCC31H12.06_DN | CTATTGGGTTCGCGGCAGGG |
| 950 | SPCC31K12.08c_UP | GTATGGGACGGCGGAAGTGG |
| 951 | SPCC31H12.08c_DN | CCCCCTCATTGCCCCTATCGT |
| 952 | SPCC320.12_UP | CGCCCGATTAGCCGAACGA |
| 953 | SPCC320.12_DN | GGCACTTTCGTGGCGGGGTT |
| 954 | SPCC320.14_UP | TCCCACGCAAGCCCATCAAA |
| 955 | SPCC320.14_DN | AAAAAAGGCAGCGCGAGACC |
| 956 | SPCC330.02_UP | ACCGAAATGACGACCCCCCC |
| 957 | SPCC330.02_DN | GGATTGGGCCCGTCTCTGAG |
| 958 | SPCC338.15_UP | CGGCCCCCTTACGCAATCAAG |
| 959 | SPCC338.15_DN | TATGGGGAGCACGACCGGGA |
| 960 | SPCC417.11c_UP | GCACCCCTCGGCACCATATT |
| 961 | SPCC417.11c_DN | GTCAAGGTCGGTTTGTGCA |
| 962 | SPCC4B3.03c_UP | CCCGGTGTATGCGCTTTTCC |
| 963 | SPCC4B3.03c_DN | GGGTCGGCCTGGAAGATGTG |
| 964 | SPCC459.01c_UP | TACGACAACGGGCCATGCAA |
| 965 | SPCC459.01c_DN | GGCCCGTCGCATCTGTCATT |
| 966 | SPCC569.08c_UP | CCACGTCCGCGCCCTCTAAT |
| 967 | SPCC569.08c_DN | GAGTACAGTGGGCTTGGGGG |
| 968 | SPCC576.06c_UP | TCCACCCGATCTCCAGCGTT |
| 969 | SPCC576.06c_DN | GGCAGGCATTTTACCGTCGG |
| 970 | SPCC584.05_UP | GCAGTGGGCGAGAGAGCCGA |
| 971 | SPCC584.05_DN | TCCCAACCCGGTCAAAGCGA |
| 972 | SPCC584.16c_UP | TGGAGGGAGGTGCGTGATGC |
| 973 | SPCC584.16c_DN | ATGGGGATCACAAGGGCTGC |
| 974 | SPCC613.04c_UP | ACATTAGCCAGACCCCCCGC |
| 975 | SPCC613.04c_DN | AGGTGCGTGGCGAGTTGGA |
| 976 | SPCC622.06c_UP | AGTCACGGGACGTCTTGGGC |
| 977 | SPCC622.06c_DN | GGGCCTGGGCATGAAAGGAG |
| 978 | SPCC645.06c_UP | AGTTGGTTCGTGCGGATGGG |
| 979 | SPCC645.06c_DN | AACCCCTACCCGCCGCCAAT |
| 980 | SPCC70.07c_UP | CCATCAGTACAGCCCGCCCG |
| 981 | SPCC70.07c_DN | CCGGCTCCCCATCCTTTGTC |
| 982 | SPCC70.09c_UP | GATTAGGGAGCGCGGGAGG |
| 983 | SPCC70.09c_DN | TTCCACCACCTGCCACCAAA |
| 984 | SPCC737.09c_UP | AAAGGGTCGGGGGGATATCG |
| 985 | SPCC737.09c_DN | GGGAAGGATGGGTGCGTTTC |
| 986 | SPCC757.06_UP | TGTCTGCATGGAAGCCGGGA |
| 987 | SPCC757.06_DN | CTAGCAAAGAACGGGGCGG |
| 988 | SPCC757.10_UP | ACCCGCCCCCAGACCAAAATA |
| 989 | SPCC757.10_DN | TGCCGTGGGCTTGAGTTCGT |
| 990 | SPCC825.03c_UP | TCCTTCTTCCGGCGCCTATG |
| 991 | SPCC825.03c_DN | CCGAGAAGGGGCCCAAATACG |
| 992 | SPCC962.01_UP | GCGCGAGGGAGAATGTGATG |
| 993 | SPCC962.01_DN | CCATAGACAGAAGGGCCGCG |
| 994 | SPCC965.03_UP | TATGCCGCCTCTCTTCCGCT |
| 995 | SPCC965.03_DN | TCCGATGTTGTGAGGAGGCG |
| 996 | SPBB22H7.07_UP | ACGGAAGTACGGGGGGCAG |
| 997 | SPBB22H7.07_DN | ATGACGTCGGCGGTGTTCCA |
| 998 | SPAC1002.10c_UP | CCCCGACCACCGAAAATGAG |
| 999 | SPAC1002.10c_DN | CGGCGAGCAAGGCATAGGGA |
| 1000 | SPAC1002.16c_UP | ATGACGGGTCGGCGTACTCGA |
| 1001 | SPAC1002.16c_DN | GAGCACGGGGCTCACGTAT |
| 1002 | SPAC1006.09_UP | CCACTCCTTCCGTATCCCGC |
| 1003 | SPAC1006.09_DN | GATAAAAGCGCGGGCCAACC |
| 1004 | SPAC1039.10_UP | GGCAATCATGGGGCGCAAAC |
| 1005 | SPAC1039.10_DN | ACGTAACACGACCGCTGGTG |
| 1006 | SPAC105.01c_UP | ACCACCCTCTCCCCCTCGTC |
| 1007 | SPAC105.01c_DN | AATGGCACGGAAGACCGCAA |
| 1008 | SPAC1071.10c_UP | ACGGGTCCTCACATCCGTCT |
| 1009 | SPAC1071.10c_DN | AAACAGTCTGGTCGCACGGA |
| 1010 | SPAC1071.12c_UP | GCTCCGGGGGTCTGCCATAA |
| 1011 | SPAC1071.12c_DN | CCGGGACGGTGGTTGAAGAT |
| 1012 | SPAC1093.06c_UP | ATCCGCCAGACATTCCCACG |
| 1013 | SPAC1093.06c_DN | AGTGGCGGGGTTGCGTTAGG |
| 1014 | SPAC110.01_UP | CGCTCGGGTGCGCTACAPTA |
| 1015 | SPAC110.01_DN | TCCCGCGCGGTCTAGTTACA |
| 1016 | SPAC1142.01_UP | AGGCCCCGTGTTGTTTGCGG |
| 1017 | SPAC1142.01_DN | CACCCCCGCCTGCTGATCTC |
| 1018 | SPAC1142.03c_UP | AAGTCGTGGCGGGGAGGCAAC |
| 1019 | SPAC1142.03c_DN | CCCCCGCTCTACCCCTTTCAC |
| 1020 | SPAC1142.05_UP | GCGTGTGTGTCCTGCTTGGG |

FIG.12

| Sequence number | Name | Base sequence |
|---|---|---|
| 1021 | SEAC1142.05_DN | CCGTCCGTCTTTGCCTGTCG |
| 1022 | SEAC11E3.10_UP | GGGCTATCCTGGTGTGGGC |
| 1023 | SEAC11E3.10_DN | AGAGGCGGGGCTAGGTCCAA |
| 1024 | SEAC1250.01_UP | CAGGCGCAAAGTACCACGG |
| 1025 | SEAC1250.01_DN | CGCCTATCCACGCCGATCCT |
| 1026 | SEAC1296.02_UP | CCGGCCATGAGGTGTCGTTT |
| 1027 | SEAC1296.02_DN | GGCCCGTGGAGGATTCATTG |
| 1028 | SEAC1296.04_UP | ATCTCACCCCGCAGGCCATT |
| 1029 | SEAC1296.04_DN | AAGCACGGCGGGAAATTGAT |
| 1030 | SEAC1296.06_UP | CCGTCACTCCCCCTCGAATC |
| 1031 | SEAC1296.06_DN | TTGGCCCCCGTGCTTCTCTT |
| 1032 | SEAC12B10.08c_UP | CGCAACGGCCGGTAGAATGT |
| 1033 | SEAC12B10.08c_DN | CAAGACTCGCTAACCGCCGC |
| 1034 | SEAC12G12.01c_UP | CGACAGGCCCAAGCCCCTAA |
| 1035 | SEAC12G12.01c_DN | GTTGACAGGGGTCGGTGGCG |
| 1036 | SEAC12G12.13c_UP | GCCAAAGCCCCCCGCAATGT |
| 1037 | SEAC12G12.13c_DN | GCCTGCCTCCTATTGCGCTCG |
| 1038 | SEAC1327.01c_UP | CGGGGCCCGTCTCGTGCTGT |
| 1039 | SEAC1327.01c_DN | GAGCACCCGTAAGGCCCATG |
| 1040 | SPAC139.06_UP | CGACCCCCCGTGAGCAACTA |
| 1041 | SPAC139.06_DN | ACATGACTTGCGCCGGTGAC |
| 1042 | SPAC13A11.01c_UP | GCGGCGTGGGGTGATTCTGT |
| 1043 | SPAC13A11.01c_DN | AGTGGATGTGGGGAGCGAC |
| 1044 | SPAC13C5.01c_UP | CGGATGGTGTCGAACTGGGG |
| 1045 | SPAC13C5.01c_DN | GTCCTCCGTGCGCTTGTTGC |
| 1046 | SPAC13D6.05_UP | TCCACGCGGCACTCACTCTT |
| 1047 | SPAC13D6.05_DN | CCGACTGGCCGAAGCAAACG |
| 1048 | SPAC13G6.01c_UP | TCCCGGGGTAGTTTGTGGCA |
| 1049 | SPAC13G6.01c_DN | ATGCGTGAGGGGGATGAACC |
| 1050 | SPAC13G6.05c_UP | TAGCTTGTGGGACCTGCGGA |
| 1051 | SPAC13G6.05c_DN | TGACCTGAGATACGCGGCGG |
| 1052 | SPAC13G6.11c_UP | CCCCCCACGGTCTTCATGTT |
| 1053 | SPAC13G6.11c_DN | CCCGTTGTTATGAGCGGCCT |
| 1054 | SPAC13G6.13_UP | CAGCTCTTCGTTGCGCGGTT |
| 1055 | SPAC13G6.13_DN | AGGGGCTCGCTCTTCTTCGCG |
| 1056 | SPAC13G6.15c_UP | CACTCACCTCCGCGGCAAGC |
| 1057 | SPAC13G8.15c_DN | AGGGTGAAGGTGGTCGGTCGG |
| 1058 | SPAC13G7.10_UP | TAAGGGTCAGGGCAGGGCGA |
| 1059 | SPAC13G7.10_DN | GGATCCGCCACCCTATTCG |
| 1060 | SPAC13G7.12c_UP | CCGGGGGTGGGGTTAGAGGA |
| 1061 | SPAC13G7.12c_DN | GGATCGGACTGGCGTAGGCG |
| 1062 | SPAC1420.01c_UP | GGGGCTAGGGATGGACCGGT |
| 1063 | SPAC1420.01c_DN | CCGCAACCGCAGATCCACAG |
| 1064 | SPAC144.07c_UP | TTTTTCCAAGCTGCCGGCT |
| 1065 | SPAC144.07c_DN | CGCATTGGTGTTGAGGGGGT |
| 1066 | SPAC144.15c_UP | GATCCGCACAGAACCTCGCC |
| 1067 | SPAC144.15c_DN | TCCATGACAAGGGCTGCCCG |
| 1068 | SPAC1486.01_UP | TGTAGCAATAACGCGCCCGG |
| 1069 | SPAC1486.01_DN | CACGTGCCGTAGTCAGGCTT |
| 1070 | SPAC1486.07c_UP | AGGGATGCGAGGACACAGG |
| 1071 | SPAC1486.07c_DN | GGACGGGTATGCTTGTTGGC |
| 1072 | SPAC1486.09_UP | GGGACGAAAGCCGAACAATG |
| 1073 | SPAC1486.09_DN | TACCTGTGTGGGCGTGGGAC |
| 1074 | SPAC14C4.15c_UP | GATGGGCGGAATTGAGGGGA |
| 1075 | SPAC14C4.15c_DN | GCAGATCAGGCGACCCGAAG |
| 1076 | SPAC1527.01_UP | CTGTGCTGTGCCCGGTATG |
| 1077 | SPAC1527.01_DN | AGTCCGCGGGTAGAAGGGG |
| 1078 | SPAC1556.06.1_UP | CGGECGGTGCAGGTGTTAGT |
| 1079 | SPAC1556.06.1_DN | TGGGTGATCTCGTGCCGCC |
| 1080 | SPAC1556.06.2_UP | CGGGCGTTGCAGGTGTTAGT |
| 1081 | SPAC1556.06.2_DN | TGGGTGATCTTCGTGCCGTC |
| 1082 | SPAC1556.08c_UP | GCCCCCCGTGCATGAAAGAT |
| 1083 | SPAC1556.08c_DN | TGCCACACCACCGCCATGAG |
| 1084 | SPAC1565.08_UP | ACCACGCCACCTCGCCCTTC |
| 1085 | SPAC1565.08_DN | AAAGGGCGGAGGGCGGAGAT |
| 1086 | SPAC15A10.12c_UP | TTTTTGTCTTCCCCGCACG |
| 1087 | SPAC15A10.12c_DN | TTAACGTCAGCCACCCCCGG |
| 1088 | SPAC15E1.06_UP | GTACGAAGGGGCCCGGAAA |
| 1089 | SPAC15E1.06_DN | GCGGGCGGATTTGTCTTGAA |
| 1090 | SPAC15E1.10_UP | CCCAAATACCCGACCGCAAC |
| 1091 | SPAC15E1.10_DN | CGTCTCCCCTTTCGCGCCTT |
| 1092 | SPAC1639.01c_UP | GATGGGCCGTTTCACGATT |
| 1093 | SPAC1639.01c_DN | AACTGATGATACCGCGGGGG |
| 1094 | SPAC167.03c_UP | GGGGTGACGTCGATTGGGGT |
| 1095 | SPAC167.03c_DN | TCCCGTCGTTTCTCCCACCCC |
| 1096 | SPAC167.05_UP | GCCGCACCCCCATGTACTG |
| 1097 | SPAC167.05_DN | GTGGGGCGCTGGAAAGGATG |
| 1098 | SPAC167.07c_UP | CTCCGCTCCTCCCGTCTCAG |
| 1099 | SPAC167.07c_DN | CGCAAAGACGCAAGGAGCAG |
| 1100 | SPAC1687.03c_UP | CTTGCGCTGCACGTTCTGGG |
| 1101 | SPAC1687.03c_DN | GCCTGCATGACGGCGAATAA |
| 1102 | SPAC1687.11_UP | TTCCCGTCCTGCGTTTGCGT |
| 1103 | SPAC1687.11_DN | AGGGGGAGGATCTTGGGCAT |
| 1104 | SPAC1687.21_UP | GGCCCTGTCGCGTAGTTTCG |
| 1105 | SPAC1687.21_DN | TGAAAAATGCGGGCGCTGGT |
| 1106 | SPAC1687.23c_UP | GATATGCGCGTCCGCAGTA |
| 1107 | SPAC1687.23c_DN | ATGGGACCCGTGTGAGAGCR |
| 1108 | SPAC16A10.08c_UP | GTCGCTCTTATCGCTGGCC |
| 1109 | SPAC16A10.06c_DN | AATTCTTGCCACCTGCGGGG |
| 1110 | SPAC16E8.03_UP | CCAAGGGCGCCAAGTTCAAC |
| 1111 | SPAC16E8.03_DN | TTGCGTACGTGCGCCATCGG |
| 1112 | SPAC16E8.07c_UP | TACGGTGGCAAGGGTGGATT |
| 1113 | SPAC16E8.07c_DN | TCAATCCGCCCAGACTCCA |
| 1114 | SPAC16E8.11c_UP | GAAATGCGTGATGGGGCAAA |
| 1115 | SPAC16E8.11c_DN | GGCTCGTGCTGGCGGTTTAG |
| 1116 | SPAC1751.03_UP | CCTCCGGTCGCTGTCCTCCT |
| 1117 | SPAC1751.03_DN | CTCTTTCCCTCCCCTGCCAT |
| 1118 | SPAC1782.01_UP | TCCCGGGCGTGCACACTTTG |
| 1119 | SPAC1782.01_DN | GAGCCGGCCTTTGGTATCCC |
| 1120 | SPAC1782.11_UP | AGCACGGATGGGGGTTTTTG |
| 1121 | SPAC1782.11_DN | GCGGGGGTGGGAGTGATGT |
| 1122 | SPAC1786.01c_UP | TTGCACATCTTTCCCGGCA |

| Sequence number | Name | Base sequence |
|---|---|---|
| 1123 | SPAC1786.01c_DN | AGGGAGGAAGATGCGCG |
| 1124 | SPAC1786.03_UP | TTTTGGTGGTTCGGTCGC |
| 1125 | SPAC1786.03_DN | ACAGCCCACAAACAGCCC |
| 1126 | SPAC17A5.07c_UP | ACCGCGCPGAGGCATTTG |
| 1127 | SPAC17A5.07c_DN | TGGGATGAGGACTGTGGG |
| 1128 | SPAC17A5.13_UP | GCGTGGCGGAGGAATTGC |
| 1129 | SPAC17A5.13_DN | GGGGAAGGGGAAAGGCCA |
| 1130 | SPAC17A5.15c_UP | AGCCAACAGCAGACGGAA |
| 1131 | SPAC17A5.15c_DN | CACACCCTTCACCGCGCA |
| 1132 | SPAC17D4.01_UP | GACAGGGCCATACCGTGG |
| 1133 | SPAC17D4.01_DN | ACCGTGTGTGACCTACGG |
| 1134 | SPAC17G6.04c_UP | AAACCGCGACAGCAAAC |
| 1135 | SPAC17G6.04c_DN | GCCCGCAACAACGAAACC |
| 1136 | SPAC17G8.01c_UP | AGATCCTGCTCCAACCCC |
| 1137 | SPAC17G8.01c_DN | GCATGGGAAAGTTGGGCG |
| 1138 | SPAC17G8.05_UP | GCTGGCTGGCGGTTGGAC |
| 1139 | SPAC17G8.05_DN | GTCCCCTATCCGCGGTCC |
| 1140 | SPAC17G8.09_UP | CTTTTGGGCTTGCGCGAG |
| 1141 | SPAC17G8.09_DN | GACCGGGATGGGGGCTGT |
| 1142 | SPAC17H9.05_UP | CGGGCTCCCCCCATAAGA |
| 1143 | SPAC17H9.05_DN | CGCTACGAGTCACTGCGT |
| 1144 | SPAC17H9.07_UP | TCCGTCGCCCCAACAACG |
| 1145 | SPAC17H9.07_DN | TTCCTCAGCCCCTCCTCG |
| 1146 | SPAC17H9.20_UP | CCGCACTCCCTTACCGCA |
| 1147 | SPAC17H9.20_DN | CCACGCACACAAAGGCAC |
| 1148 | SPAC1805.08_UP | TATTAAGCCCCGAAGCCG |
| 1149 | SPAC1805.08_DN | TTCCCGAGCAAAGTCACC |
| 1150 | SPAC1805.14_UP | ATCAGAATGGCAAAGGGC |
| 1151 | SPAC1805.14_DN | TTGGCCCGCTTTTACCCG |
| 1152 | SPAC1934.11c_UP | CCTGGGGAAGATGGGGTTT |
| 1153 | SPAC1834.11c_DN | ATCAAGACCCCGCGCAGA |
| 1154 | SPAC1951.02_UP | TCTCTCGCCTCCACTTGC |
| 1155 | SPAC1951.02_DN | AGGCGTAGGCGAGACAGG |
| 1156 | SPAC1951.04c_UP | CGGGGGGTTAATCAGCGT |
| 1157 | SPAC1951.04c_DN | TCTTTTTCATGGTGGCGG |
| 1158 | SPAC19B11.08c_UP | GATGGGGCCTTTCTCCGT |
| 1159 | SPAC19B11.08c_DN | CGTTGCGGCAATGCTGTT |
| 1160 | SPAC1952.01_UP | AAACCGGACCCTTCCATC |
| 1161 | SPAC1952.01_DN | TCCCGCCCCTTTTGAAGC |
| 1162 | SPAC19A8.01c_UP | TGTGAAGAAGTAGCCCGC |
| 1163 | SPAC19A8.01c_DN | GCGCGCACGATGGATAGA |
| 1164 | SPAC19A8.11c_UP | CTGATGTGGAGAGCGGCG |
| 1165 | SPAC19A8.11c_DN | ACCCCCTCCCGATTGCTT |
| 1166 | SPAC19A8.15_UP | TTTGTCATGGGGCGTTTT |
| 1167 | SPAC19A8.15_DN | ATTCCCCGCTTGCGTATG |
| 1168 | SPAC19E9.03_UP | ACCGATGCGCTCGCTGAG |
| 1169 | SPAC19E9.03_DN | TCTCCACCTCTTTCCGCC |
| 1170 | SPAC1A6.02_UP | GCGGGTTATGTGGTTGCC |
| 1171 | SPAC1A6.02_DN | CGCCCACCCTCTTGCCTC |
| 1172 | SPAC1A6.10_UP | CCCGTCTCGCCCCAACCT |
| 1173 | SPAC1A6.10_DN | CGTCCGTCGGCCCCATAA |
| 1174 | SPAC1B2.03c_UP | CAGAACGGGCGGACGAGA |
| 1175 | SPAC1B2.03c_DN | TGTTATTCCGAAGCGCCC |
| 1176 | SPAC1B2.05_UP | GCGCGGCACGTAATCCAT |
| 1177 | SPAC1B2.05_DN | TCACCTGTTGGCGGCATC |
| 1178 | SPAC1E3.14_UP | ACTGGCTCACTGCCCCCT |
| 1179 | SPAC1E3.14_DN | TTCCGGCACCACACGAGG |
| 1180 | SPAC1D4.01_UP | CCCACCCAATACCAGCCG |
| 1181 | SPAC1D4.01_DN | GGGACGACTGACACCATG |
| 1182 | SPAC1E5.06_UP | ATTCTGCGGGAGAGCTTG |
| 1183 | SPAC1E5.06_DN | CCATGCCATCTGAGCCCA |
| 1184 | SPAC1E7.01c_UP | CCGATACTCAAAGGGCCX |
| 1185 | SPAC1E7.01c_DN | CGGGGGTAGTGGTTGGCT |
| 1186 | SPAC1E7.05_UP | CAGAACGCATCCGCCCGA |
| 1187 | SPAC1E7.05_DN | GACTGCGGTGGGGGGCT |
| 1188 | SPAC1E7.13c_UP | CCACCGACAACGACCCTC |
| 1189 | SPAC1E7.13c_DN | CGTCCGCAACTCCCTTCT |
| 1190 | SPAC20G4.08_UP | AAGCACCTCCAACATCGC |
| 1191 | SPAC20G4.08_DN | CAGCCGCAAACAACGGGCA |
| 1192 | SPAC2068.02_UP | CACCAGCAAAATCGCCGC |
| 1193 | SPAC2068.02_DN | GCATGTAGGCGGGGGTCC |
| 1194 | SPAC20G8.10c_UP | TCGGTGAGAAGGGCGTGA |
| 1195 | SPAC20G8.10c_DN | GCGTACAGCGGGAATGGC |
| 1196 | SPAC222.03c_UP | CTGCGCGGTATCGAGGAA |
| 1197 | SPAC222.03c_DN | ACGACCGACGCCACTTTC |
| 1198 | SPAC222.11_UP | GCCAACATGCACCAACCC |
| 1199 | SPAC222.11_DN | TACATGTTGGGGTGCGH |
| 1200 | SPAC222.15_UP | TCTGCAACGCTCCCGACG |
| 1201 | SPAC222.15_DN | GCTCGGTAGGCGGGTTT |
| 1202 | SPAC227.01c_UP | CTACCCCCGCCAGCAAA |
| 1203 | SPAC227.01c_DN | TCGCATAGGCCACTGAG |
| 1204 | SPAC22A12.01c_UP | AAACGGAACTCTTCGCCC |
| 1205 | SPAC22A12.01c_DN | CTGCGCGACTCCCCTCGA |
| 1206 | SPAC22E12.08_UP | GGACCTTTCATGCCCTCT |
| 1207 | SPAC22E12.08_DN | CTCGCCTCATAGGCCAA |
| 1208 | SPAC22F8.05_UP | AGCGTACTCGCTGACAG |
| 1209 | SPAC22F8.05_DN | TTACCTAGGGCCCCGGA |
| 1210 | SPAC22F8.09_UP | GTCTCGGCCCGTTGTCG |
| 1211 | SPAC22F8.09_DN | GTAACACTATGCCCACC |
| 1212 | SPAC22F8.10c_UP | GCGGTTCTGGGGCTGCA |
| 1213 | SPAC22F8.10c_DN | GTGGGGGTGAGAGATG |
| 1214 | SPAC22F8.12c_UP | TGGGGATGCGGATGAAA |
| 1215 | SPAC22F8.12c_DN | GGCTTGCTGAATCTGGC |
| 1216 | SPAC22H10.02_UP | AGGGATAAGGCGGGGGT |
| 1217 | SPAC22H10.02_DN | TCGCCCGCCTCCCACTG |
| 1218 | SPAC22H10.12c_UP | AGCCTCGGAGATAGCCA |
| 1219 | SPAC22H10.12c_DN | GGCCCGCTCCCACAAAA |
| 1220 | SPAC22H12.01c_UP | ACGCATCTAACCCCCGC |
| 1221 | SPAC22H12.01c_DN | GCACGGTTTTTGATGGG |
| 1222 | SPAC23A1.03_UP | GTGCGGTCCCAATTACC |
| 1223 | SPAC23A1.03_DN | GAGCCACCGCCCGACAT |
| 1224 | SPAC23A1.05_UP | TATCTTCTCGCCCCTCC |

FIG.13

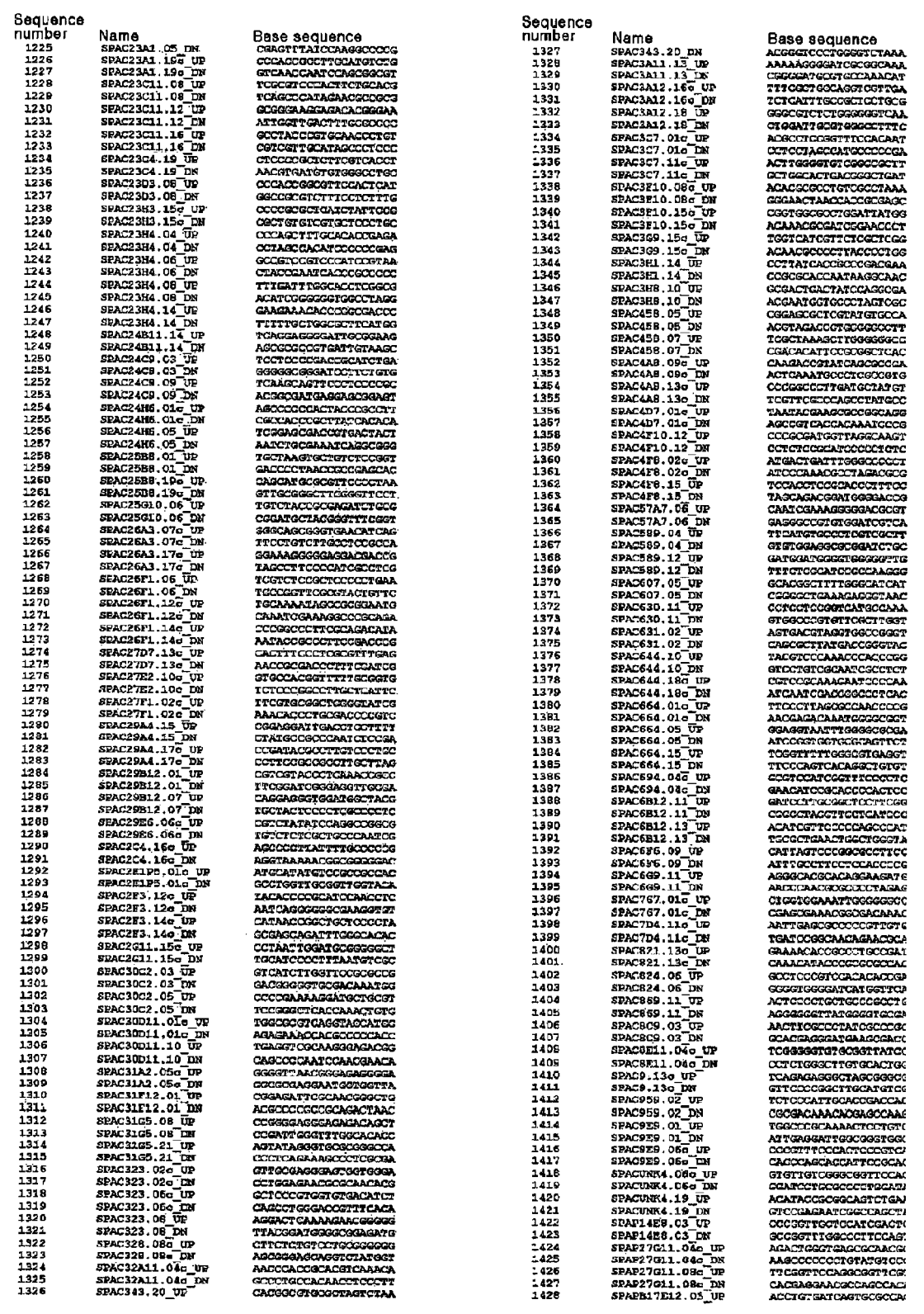

The figure shows a large table of DNA sequences with columns for Sequence number, Name, and Base sequence. Due to the extremely small text and dense tabular data containing hundreds of sequence entries that are largely illegible at this resolution, the full content cannot be reliably transcribed.

Figure 15:
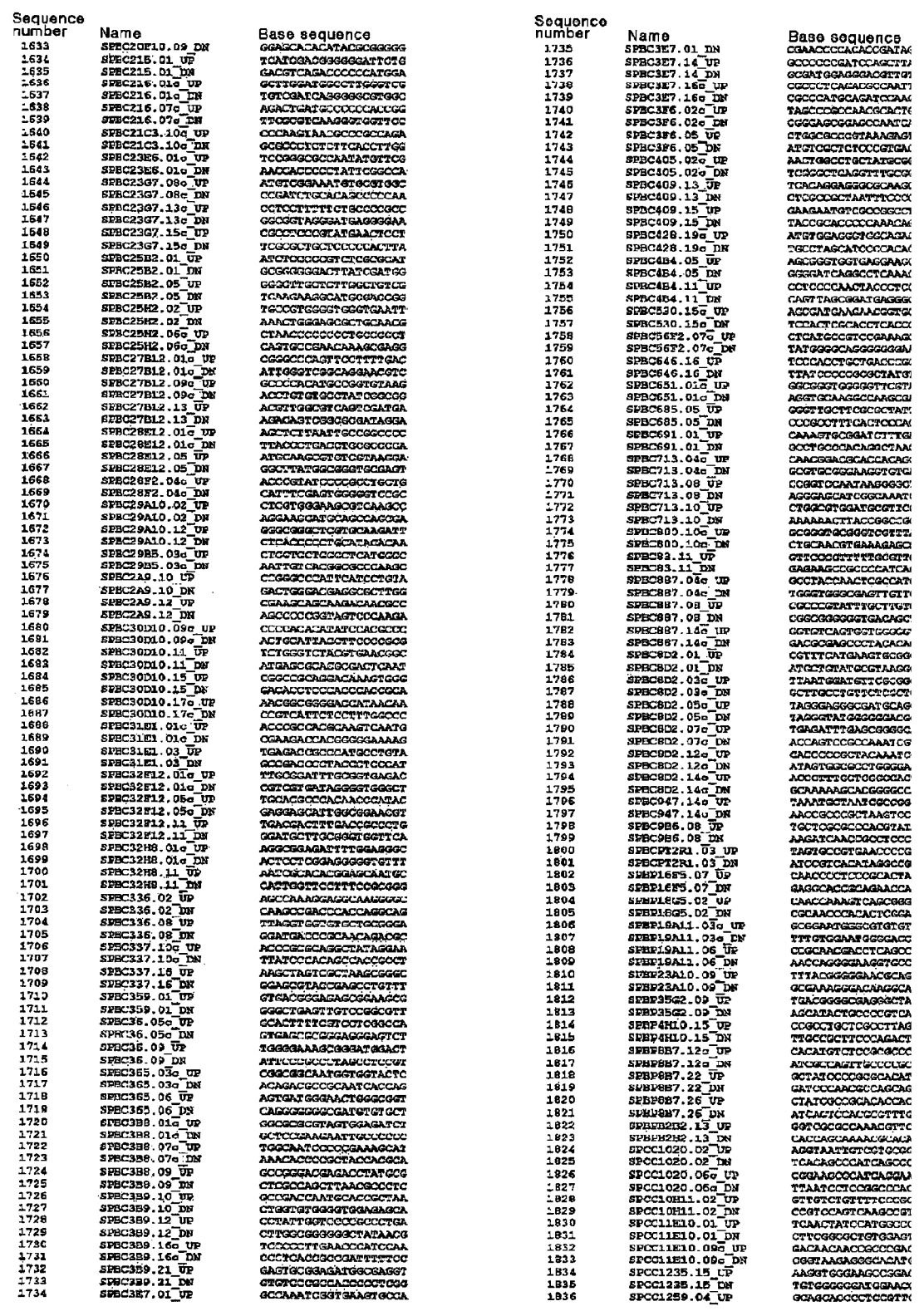

The image is too low-resolution to reliably transcribe the sequence table contents.

FIG.16

| Sequence number | Name | Base sequence | Sequence number | Name | Base sequence |
|---|---|---|---|---|---|
| 1837 | SPCC1259.04_DN | ACTTGAGGCATGGGGATCGG | 1939 | SPCC4B3.02c_DN | CGCGCCCATTGATACCGTGT |
| 1838 | SPCC126.01c_UP | CCTACCCACCGCGCCAAACA | 1940 | SPCC4B3.18_UP | GGGTGGTTGGACTGGGCGAT |
| 1839 | SPCC126.01c_DN | ATGGCCTCGGGTAACAAGCG | 1941 | SPCC4B3.18_DN | TGCTTGCTGGGTGGTTTCAT |
| 1840 | SPCC126.15c_UP | ATTCGGCTAGTCCCCGGCCTC | 1942 | SPCC4E9.02_UP | CGTTATATGCGCCGGCGAGA |
| 1841 | SPCC126.15c_DN | TTCCGCGCTTAATTGACCCC | 1943 | SPCC4E9.02_DN | TAGGCGTGAGCCCAGTAGGT |
| 1842 | SPCC1322.01_UP | GTTAGTGGCCCCCGCGGTA | 1944 | SPCC4G3.10c_UP | AACGGTCCGGGCCCTAATA |
| 1843 | SPCC1322.01_DN | CTGGTGCGATCGTGTGAGCG | 1945 | SPCC4G3.10c_DN | TAGTGCGCGACCTCTGGACT |
| 1844 | SPCC1322.11_UP | CCCCTATGCCCAACGCCACT | 1946 | SPCC4G3.12c_UP | ATCGGCGCGCTACGACAGAT |
| 1845 | SPCC1322.11_DN | CCCTTGCCCCGGTTAAGACA | 1947 | SPCC4G3.12c_DN | TCGCTCCGCGAAAGTACCGA |
| 1846 | SPCC1393.11_UP | TCGCTTCCAATTCGGCCGTG | 1948 | SPCC553.01c_UP | GCCCCCCGCCGTTTTGTAGAG |
| 1847 | SPCC1393.11_DN | CGCCTCTCGTGTGATCGTCC | 1949 | SPCC553.01c_DN | ATCGTACCGCAACCCCCGTG |
| 1848 | SPCC13B11.04c_UP | GATTAAGCCAAAAGCCGCCG | 1950 | SPCC553.12c_UP | AGGGCGACGGAGCAGGGATG |
| 1849 | SPCC13B11.04c_DN | CGAAACTGGACTGCCCCCTC | 1951 | SPCC553.12c_DN | ACTAAGCCCGTTCCCCGCCA |
| 1850 | SPCC1442.02_UP | GTCCCGTAACCCCTGCATGC | 1952 | SPCC576.01c_UP | TTGACCATCGCCTCGCCTTC |
| 1851 | SPCC1442.02_DN | CTCGAAGTCCCGTCCCGCCT | 1953 | SPCC576.01c_DN | ACCTCCCCCAACAGACCGCT |
| 1852 | SPCC1442.06_UP | GGACTACCCACGGCCGCAAC | 1954 | SPCC594.01_UP | TCGAAAAGCTACCGGGCACG |
| 1853 | SPCC1442.06_DN | AGCGCGCAATTAACGTGGAA | 1955 | SPCC594.01_DN | GTGGTCGCCCCGTCTTTCAG |
| 1854 | SPCC1442.16c_UP | TCTCGGATGGGACGGTGGTT | 1956 | SPCC5E4.04_UP | CCTAACGGGTTCGCTGTCCA |
| 1855 | SPCC1442.16c_DN | GACAAGTGAAGCGGGGAGCC | 1957 | SPCC5E4.04_DN | AGATGAGCGATGAGCCCCGA |
| 1856 | SPCC1450.13c_UP | TGTACGCTCTAGGTGCCACG | 1958 | SPCC61.04c_UP | TTGCGGGTTGGGGTAGCTTG |
| 1857 | SPCC1450.13c_DN | GAGACTGCGTAGGCCGACAT | 1959 | SPCC61.04c_DN | ACACCCCGAACCGCCGCTACT |
| 1858 | SPCC1450.15_UP | TCGCCGGAGCTCCCTTAACA | 1960 | SPCC613.01_UP | ATCGCCCGCTCCAGGCTAAC |
| 1859 | SPCC1450.15_DN | TTCGCTTTCGTTACCGGGCT | 1961 | SPCC613.01_DN | TAAGTGCGGGTGCTGGGCAG |
| 1860 | SPCC1494.01_UP | AGAGAGACCGAGCCTCGCAT | 1962 | SPCC622.19_UP | GCTTTCGAGTCATGGCGCGC |
| 1861 | SPCC1494.01_DN | CGCCCACCATTAAGCAACCG | 1963 | SPCC622.19_DN | CGTCTCGCGCTCCCTTCTCG |
| 1862 | SPCC14G10.02_UP | AGCCACATGGGGATCCGCTT | 1964 | SPCC645.03c_UP | TGTGCGTGGTGTGGAGTGCG |
| 1863 | SPCC14G10.02_DN | AACGGCTTACCTACGGCCTC | 1965 | SPCC645.03c_DN | TGCTAGTGTTGGGTCCGCTG |
| 1864 | SPCC14G10.04_UP | TCAAGCCGATCTGACGGGTG | 1966 | SPCC663.01c_UP | GCTGGATGCCCGGGACTGTTG |
| 1865 | SPCC14G10.04_DN | GGAACTGGGGCCGTAAAGCG | 1967 | SPCC663.01c_DN | TATTAGCTTGGCGCCGGTGG |
| 1866 | SPCC162.09c_UP | AGCACAGCGGATCTCCTGGGT | 1968 | SPCC663.13c_UP | CGGACTGGCGGACTGAGGG |
| 1867 | SPCC162.09c_DN | TCCTGTCCGTATGCTGTCGC | 1969 | SPCC663.13c_DN | AAAGGTGGGCGTTGGTCTCG |
| 1868 | SPCC162C.01c_UP | TATCTGCTAGCGCTATGGGCG | 1970 | SPCC70.06_UP | TAATACGGCTCCCGCCACCA |
| 1869 | SPCC162C.01c_DN | ATGGCGTGCAGCCTGACATA | 1971 | SPCC70.06_DN | CGACCCACTTTATCGCGCCG |
| 1870 | SPCC162C.05_UP | TCGTGCTCACACGGTCGATG | 1972 | SPCC74.05_UP | GATCTTGGGGGACGCTCCGG |
| 1871 | SPCC162C.05_DN | TGACTGGGGTGCGAGGAGA | 1973 | SPCC74.05_DN | CCATGGGGAGCGCAAGAAC |
| 1872 | SPCC16B2.01_UP | AGCGAGCGCAAGGCTTAGGA | 1974 | SPCC794.15_UP | CCCTTGCTAATGCCCGTTCG |
| 1873 | SPCC16B2.01_DN | AGAGCCGCGTAGATACGGGT | 1975 | SPCC794.15_DN | AGCCGCCCGTCATACCATCA |
| 1874 | SPCC16B2.10_UP | TCCAGGCACTCTCTCGCAT | 1976 | SPCC962.02c_UP | CCAGCAGCAACCCAGACCCC |
| 1875 | SPCC16B2.10_DN | GCGACTGACGGAAACCCCCA | 1977 | SPCC962.02c_DN | TCATTACCCGACCGACGT |
| 1876 | SPCC16A11.02_UP | TGACATCGCTCAGTCGGGAG | 1978 | SPAC56F8.16_UP | GACTAACCGTCGGGGCTCAT |
| 1877 | SPCC16A11.02_DN | TGCGAACAGGTCTCCACGTC | 1979 | SPAC56F8.16_DN | TCGTTAGCGTGGCACCTATG |
| 1878 | SPCC16C4.19_UP | CCAACGGATTTTCCACCGCT | 1980 | SPAC1002.01_UP | GCTTGGTTAGTGGACGCCCC |
| 1879 | SPCC16C4.19_DN | TGGGGGATTTGAGGCATGGA | 1981 | SPAC1002.01_DN | CAGGAAACATTACGCCGCCC |
| 1880 | SPCC1739.01_UP | TGTGCCGCTCCGGTTGCCTTC | 1982 | SPAC1002.02_UP | TGGTTTCACGACATGGCGCA |
| 1881 | SPCC1739.01_DN | ACATAGCCACCGCCACCAG | 1983 | SPAC1002.02_DN | AGGGGGATTGTCGAAGCGGG |
| 1882 | SPCC1739.15_UP | AGGTCGACCCGCGGTAAAGGT | 1984 | SPAC1002.03c_UP | CTAGGCGGCCGGGCTTCAAA |
| 1883 | SPCC1739.15_DN | TTCCGCTCGGACGGATTCTG | 1985 | SPAC1002.03c_DN | CGCGGCGGCATAATTACGTTT |
| 1884 | SPCC1753.01c_UP | GGGGGGTTAGGGTCAACAGAG | 1986 | SPAC1007.04c_UP | AGCACAGGCCGCGATTATGA |
| 1885 | SPCC1753.01c_DN | CAAACGGGACGCCACAATCA | 1987 | SPAC10C2.04c_DN | ACCCGGGACGAAGTCAAGCA |
| 1886 | SPCC1795.02c_UP | ATTCCGCCCGCCTCCCAGTCAG | 1988 | SPAC1002.05c_UP | TTCCCTCAAGACCCGCCTGC |
| 1887 | SPCC1795.02c_DN | CCTCCCCCAGCGGTCCTTTT | 1989 | SPAC1002.05c_DN | AAAAGTGGAGGGGGCACGGG |
| 1888 | SPCC1795.08c_UP | CGGTTATAGTCGACGGGCCA | 1990 | SPAC1002.06c_UP | TGTTTGGCCCCGCACTTTCA |
| 1889 | SPCC1795.08c_DN | ACACGGCTCGCGCATATTGA | 1991 | SPAC1002.06c_DN | GCAGGCGATGGACGAGCAGT |
| 1890 | SPCC1B.04_UP | GAGGTGGGCAGCAGGGTAGG | 1992 | SPAC1002.07c_UP | AACGTTAGCCGTCGGCCCCT |
| 1891 | SPCC1B.04_DN | GCAGGGGGACTTGGTCGGTC | 1993 | SPAC1002.07c_DN | GTGTGCGCTTTAGACGGGC |
| 1892 | SPCC1B.18c_UP | CGAGTGGAAGGGGTGACGCT | 1994 | SPAC1002.09c_UP | CCCCTCACCCACAGGACCCA |
| 1893 | SPCC1B.18c_DN | TGCCGTTAGCGGTCTACGGA | 1995 | SPAC1002.08c_DN | TCGCAGCCCGCCCTTTAGTG |
| 1894 | SPCC1827.06c_UP | CGACGGGACCTAAAATGCGCA | 1996 | SPAC1002.11_UP | CTACGCACGTGCACAATCGC |
| 1895 | SPCC1827.06c_DN | ACCGCGACCAACCAATACCC | 1997 | SPAC1002.11_DN | ACGGGCCGTATAGAGTGTGC |
| 1896 | SPCC1840.12_UP | CGACTCCCGAGGCATAAGGG | 1998 | SPAC1002.12c_UP | CCTCAATCGGCCACAAGCCC |
| 1897 | SPCC1840.12_DN | ACGGCAGCCAGTTGCCCCAAG | 1999 | SPAC1002.12c_DN | AGGGCTGCCGTGAGGCTTCA |
| 1898 | SPCC1B.12_UP | ATGGGGGGCGTGGTTATCGA | 2000 | SPAC1002.13c_UP | TTGCGGGATGCTTCGAGCAC |
| 1899 | SPCC1B.12_DN | GCCCGCCTGTCTTTGCCACA | 2001 | SPAC1002.13c_DN | ATCTCCGCTAGACTCGCCCT |
| 1900 | SPCC1B85.01c_UP | TCGCTAACCTCAACGCACGA | 2002 | SPAC1002.14_UP | TGCATGACACCATACCGCCG |
| 1901 | SPCC1B85.01c_DN | ACACCACCCCAACAGCGAAG | 2003 | SPAC1002.14_DN | CGCTAGGCCATTTCGGCATC |
| 1902 | SPCC1B85.03_UP | TGTCCCCACCGCTAAGCACC | 2004 | SPAC1002.15_UP | CCACGGGTTTACGGCAAGC |
| 1903 | SPCC1B85.03_DN | TACCCCCCGCACTCCTACGC | 2005 | SPAC1002.15c_DN | TATGCCACTATGCCGGCCAG |
| 1904 | SPCC191.02c_UP | TTGACAGCTGTGGTGGGGGC | 2006 | SPAC1002.17c_UP | CAGAGTGGGTGGCTAGGGGC |
| 1905 | SPCC191.02c_DN | TGCATGTCCAAACCCTCCCG | 2007 | SPAC1002.17c_DN | TCTTCGCGCGACCTCTCGTA |
| 1906 | SPCC1919.01_UP | CCTCGCCCACTCACCACCAG | 2008 | SPAC1002.18_UP | GGGTTTCACGGTTCTGGGCC |
| 1907 | SPCC1919.01_DN | CATTGCCTTTGACTTCGCCG | 2009 | SPAC1002.18_DN | ATGATCGAGGCCGCGGCTAA |
| 1908 | SPCC1919.11_UP | TACTGCACGCCCATTGCCGG | 2010 | SPAC1002.19_UP | CAAATCCTCCCGCGTGACCA |
| 1909 | SPCC1919.11_DN | GCCCCCAGCTAATCCGAATG | 2011 | SPAC1002.19_DN | GTTCCTCCTTTGCGCGGTTG |
| 1910 | SPCC1919.15_UP | TCGTTCTGGTGGCGTGCTG | 2012 | SPAC1002.20_UP | CAGCCGTCGCACGCTAAATG |
| 1911 | SPCC1919.15_DN | CACCCTCACTCACGCCCCCA | 2013 | SPAC1002.20_DN | TCGTGCCACGTGTGTGCTTT |
| 1912 | SPCC24B10.18_UP | TGCTTGCGGGGTTTTGCTCG | 2014 | SPAC1006.01_UP | AGGACGGGATGCGGAGAGAG |
| 1913 | SPCC24B10.18_DN | GGCCAGACAAGACCCAACGC | 2015 | SPAC1006.01_DN | TTGATGCTCGTTGCTTGGCG |
| 1914 | SPCC24B10.22_UP | TCGCCAGTTCTCGCCCACAA | 2016 | SPAC1006.02_UP | GGGTGGACTGGACAGGCGAG |
| 1915 | SPCC24B10.22_DN | GATTGCCGTCCGACGGGCTT | 2017 | SPAC1006.02_DN | ACCCCGACACCCAAAACCTG |
| 1916 | SPCC297.06c_UP | AGGGGCGGGTGTCTGCAAGA | 2018 | SPAC1006.03c_UP | CTTGGGGCCTTCCGTGTTGG |
| 1917 | SPCC297.06c_DN | GGATGGGCAGGATGAGCTCG | 2019 | SPAC1006.03c_DN | GAGGCTCACGGTCAGGTT |
| 1918 | SPCC2H8.05c_UP | AACCGCCAATCCCCAGCTTT | 2020 | SPAC1006.04c_UP | TCCGTGCCGCGTTATTGTG |
| 1919 | SPCC2H8.05c_DN | GGACATTGCGGGGGACCTC | 2021 | SPAC1006.04c_DN | GCGCGGGATGTGGTAGAACT |
| 1920 | SPCC306.03c_UP | CCCGGGTTACTCCGTCGCAC | 2022 | SPAC1006.05c_UP | ATATGGGTGCCTGGGGCTCA |
| 1921 | SPCC306.03c_DN | GCACGCCTAAACGCAACCGGT | 2023 | SPAC1006.05c_DN | ACACACACCGAAGCCGGGAG |
| 1922 | SPCC306.07c_UP | TCGGTTGAGTTGGGCGTCGGA | 2024 | SPAC1006.06_UP | CGGGCGGTGGCGAGTATGAC |
| 1923 | SPCC306.07c_DN | CGCGGTCGTGAAGTATGCGC | 2025 | SPAC1006.06_DN | ATTCACCCGCATGTCCGTCG |
| 1924 | SPCC31H12.07_UP | TGCCTTCCCTCACCCATCCG | 2026 | SPAC1006.07_UP | GCCGACCTATCCCGTCGCACC |
| 1925 | SPCC31H12.07_DN | CCCCCCAATTGGTGTGTCG | 2027 | SPAC1006.07_DN | GCCCAATGAGCGNACCCTGC |
| 1926 | SPCC320.11c_UP | TGGGCAACCCAAAAGCACT | 2028 | SPAC1039.01_UP | TCGTTCCCACCGCGCTATCT |
| 1927 | SPCC320.11c_DN | GGGCCAAGGTGAAAGGGGAT | 2029 | SPAC1039.01_DN | GGGCATAGGACGGCGGGATT |
| 1928 | SPCC320.13c_UP | TTCGGTGCGCCCCTTATTCGG | 2030 | SPAC1039.02_UP | GCGGTCTGGAGTTGGGTGGT |
| 1929 | SPCC320.13c_DN | CGCATCCCGCGTCCACCCTCG | 2031 | SPAC1039.02_DN | AGTGACAGAGGGGGCCAGGA |
| 1930 | SPCC330.01c_UP | GACGGGGTGGCAAGGGCATA | 2032 | SPAC1039.03_UP | GCACGGACCAGTCGTGAGAT |
| 1931 | SPCC330.01c_DN | GTGATAGGGCGCGAGAAGG | 2033 | SPAC1039.03_DN | CGGGCGTACAAAGGGCAAAG |
| 1932 | SPCC338.05c_UP | GCCGATTTTCCCACTGCTG | 2034 | SPAC1039.04_UP | AGCACCCGCCAAATCAAAC |
| 1933 | SPCC338.05c_DN | GACCAAAAACGACGGCGCAC | 2035 | SPAC1039.04_DN | AGGGGCTCGGTTTTAGGAGG |
| 1934 | SPCC338.07c_UP | TTGACCCATTAGCCGGAGCG | 2036 | SPAC1039.05c_UP | TGTCGACGCATCGTGGGAGT |
| 1935 | SPCC338.07c_DN | TCGTCGCAGTCAGTTGGGGG | 2037 | SPAC1039.05c_DN | CGGGAAGCTGCAAGATGCGG |
| 1936 | SPCC364.02c_UP | TGACGTTTCGGCGCCTTCTC | 2038 | SPAC1039.06_UP | TTCAGTCCAACGCCCATCG |
| 1937 | SPCC364.02c_DN | GCTTTGGCGGCGTTTGTTGG | 2039 | SPAC1039.06_DN | GCGGGGGACGTAGCAACAC |
| 1938 | SPCC4B3.02c_UP | GCATCAACACGGCCCCAAC | 2040 | SPAC1039.07c_UP | CCCGTGTTTCCTCGAGCCTG |

Figure 19:
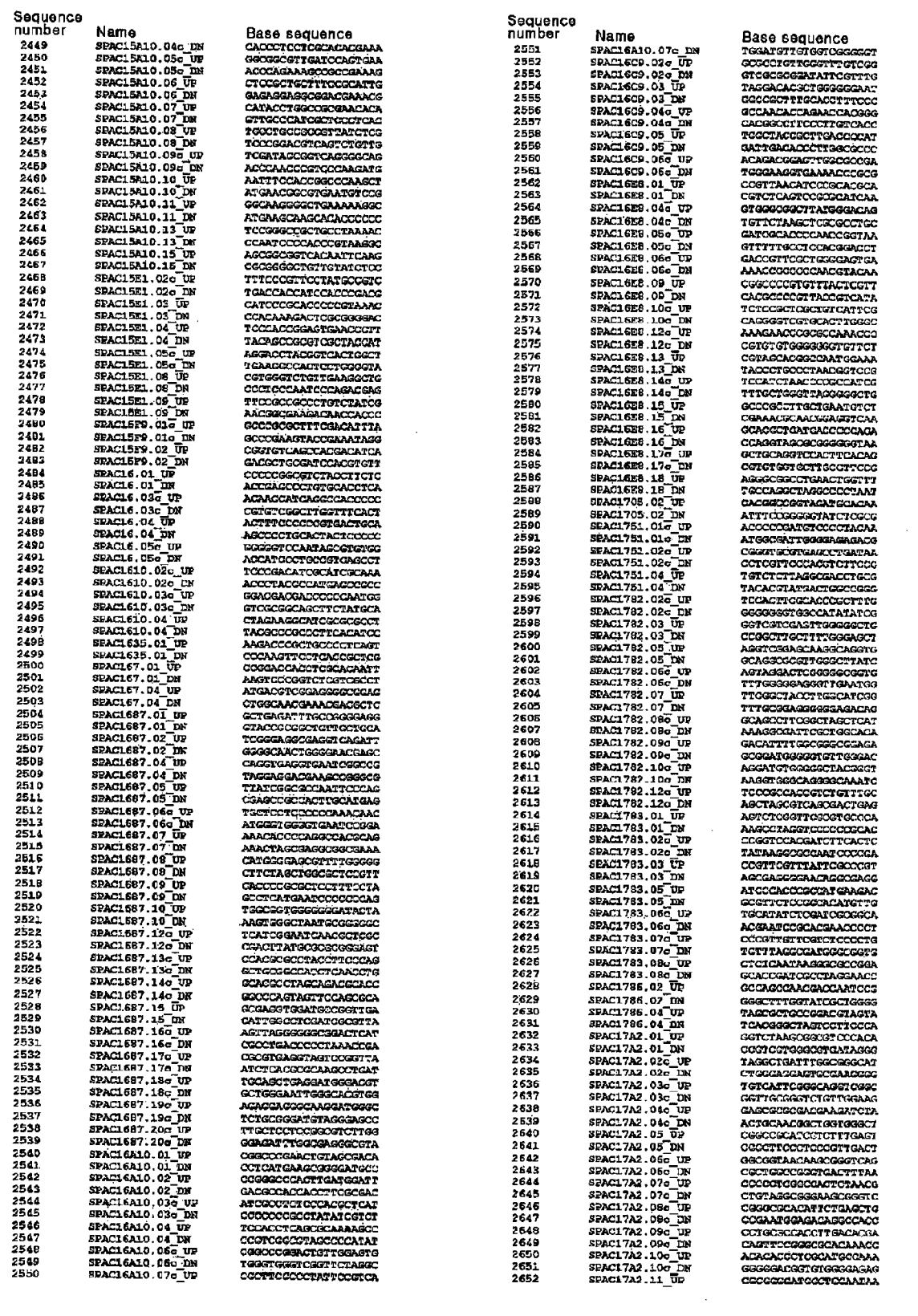

| Sequence number | Name | Base sequence |
|---|---|---|
| 2449 | SPAC15A10.04c_DN | CACCCTCCTCGCACACGAAA |
| 2450 | SPAC15A10.05c_UP | GGCGGCGTTGATCCAGTGAA |
| 2451 | SPAC15A10.05c_DN | ACCCAGAAAGCCGCCGAAAG |
| 2452 | SPAC15A10.06_UP | CTCCGCTGCTTTCCGCATTG |
| 2453 | SPAC15A10.06_DN | GAGAGGAGGCGGACGAAACG |
| 2454 | SPAC15A10.07_UP | CATACCTGGCCGCGAACACA |
| 2455 | SPAC15A10.07_DN | GTTGCCCATCGCTGCCTCAC |
| 2456 | SPAC15A10.08_UP | TGGCTGCCGCCGTTATCTCG |
| 2457 | SPAC15A10.08_DN | TCCCGGACGTCAGTCTGTTG |
| 2458 | SPAC15A10.09c_UP | TCGATAGCGGTCAGGGGCAG |
| 2459 | SPAC15A10.09c_DN | ACCCAACCCGTCCCAAGATG |
| 2460 | SPAC15A10.10_UP | AATTTCCACCGGCCCAAGCT |
| 2461 | SPAC15A10.10_DN | ATGAACGGCGTGAATGTCCG |
| 2462 | SPAC15A10.11_UP | GGCAAGGGGCTGAAAAAGGC |
| 2463 | SPAC15A10.11_DN | ATGAAGCAAGCACACCCCCC |
| 2464 | SPAC15A10.13_UP | TCCGGGCCGCTGCCTAAAAC |
| 2465 | SPAC15A10.13_DN | CCAATCCCCACCCGTAAGGC |
| 2466 | SPAC15A10.15_UP | AGCGGCGGTCACAATTCAAG |
| 2467 | SPAC15A10.15_DN | CGCGGGGCTGTTGTATCTCC |
| 2468 | SPAC15E1.02c_UP | TTTCCCGTTCCTATGCCGTC |
| 2469 | SPAC15E1.02c_DN | TGACCACCATCCACCCGACG |
| 2470 | SPAC15E1.03_UP | CATCCCGCACCCCCGTAAAC |
| 2471 | SPAC15E1.03_DN | CCACAAAGACTCGCGGGGAC |
| 2472 | SPAC15E1.04_UP | TCCCACCGGAGTGAACCCTT |
| 2473 | SPAC15E1.04_DN | TACAGCCGCGTCGCTACCAT |
| 2474 | SPAC15E1.05c_UP | AGGACCTACGGTCACTGGCT |
| 2475 | SPAC15E1.05c_DN | TGAAGGCCACTCCTGGGGTA |
| 2476 | SPAC15E1.08_UP | CGTGGGTCTGTTGAAGGCTG |
| 2477 | SPAC15E1.08_DN | CCCTCCCAATCCCAGACGAG |
| 2478 | SPAC15E1.09_UP | TTCCGCCGCCCTGTCTATCG |
| 2479 | SPAC15E1.09_DN | AACGGCGAAGACAACCACCC |
| 2480 | SPAC15F9.01c_UP | GCCCGCGCTTTCGACATTTA |
| 2481 | SPAC15F9.01c_DN | GCCCGAAGTACCGAAATAGG |
| 2482 | SPAC15F9.02_UP | CGGTGTCAGCCACGACATCA |
| 2483 | SPAC15F9.02_DN | GACGCTGCGATCCACGTGTT |
| 2484 | SPAC16.01_UP | CCCCCGGCGTCTACCTTCTC |
| 2485 | SPAC16.01_DN | ACCGAGCCCTGTGCACCTCA |
| 2486 | SPAC16.03c_UP | ACAAGCCATCAGGCCACCCC |
| 2487 | SPAC16.03c_DN | CGTGTCGGCTTGGTTTCACT |
| 2488 | SPAC16.04_UP | ACTTTCCCCCGGTGACTGCA |
| 2489 | SPAC16.04_DN | AGCCCCTGCACTACTCCCCC |
| 2490 | SPAC16.05c_UP | GGGGGTCCAATAGCGTGTGG |
| 2491 | SPAC16.05c_DN | ACCATGCCTGCCGTGAGCCT |
| 2492 | SPAC1610.02c_UP | TCCCGACATCGCATCGCAAA |
| 2493 | SPAC1610.02c_DN | ACCCTACGCCATGAGCCGCC |
| 2494 | SPAC1610.03c_UP | GGACGACGACCCCCCAATGG |
| 2495 | SPAC1610.03c_DN | GTCGCGGCAGCTTCTATGCA |
| 2496 | SPAC1610.04_UP | CTAGAAGGCATCGCGCGCCT |
| 2497 | SPAC1610.04_DN | TACGCCCGCCCTTCACATCC |
| 2498 | SPAC1635.01_UP | AAGACCCGCTGCCCCTCAGT |
| 2499 | SPAC1635.01_DN | CCCAAGTTCCTCACCGCTCG |
| 2500 | SPAC167.01_UP | CCGGACCACCTCGCACAATT |
| 2501 | SPAC167.01_DN | AAGTCCCGGTCTCGTCGCCT |
| 2502 | SPAC167.04_UP | ATGACGTCGGAGGGGCCGAC |
| 2503 | SPAC167.04_DN | CTGGCAACGAAACGACGCTC |
| 2504 | SPAC1687.01_UP | GCTGAGATTTGCCGGGGAGG |
| 2505 | SPAC1687.01_DN | GTACCGCGGCTGTTGCTGCA |
| 2506 | SPAC1687.02_UP | TCGGGAGGCGAGGTCAGATT |
| 2507 | SPAC1687.02_DN | GGGGCAACTGGGGAACGAGC |
| 2508 | SPAC1687.04_UP | CAGGTGAGGTGAATCGGCCG |
| 2509 | SPAC1687.04_DN | TAGGAGGACGAAGCCGGGCG |
| 2510 | SPAC1687.05_UP | TTATCGGCGCCAATTCCCAG |
| 2511 | SPAC1687.05_DN | CGAGCCGCCACTTGCATGAG |
| 2512 | SPAC1687.06c_UP | TGCTCCTCCCCCCAAACAAC |
| 2513 | SPAC1687.06c_DN | ATGGGTGGGTGAATCCGGA |
| 2514 | SPAC1687.07_UP | AAACACCCCAGGCCACGCAG |
| 2515 | SPAC1687.07_DN | AAACTAGCGAGGCGGCGAAA |
| 2516 | SPAC1687.08_UP | CATGGGGAGCGTTTTGGGGG |
| 2517 | SPAC1687.08_DN | CTTCTAGCTGGCGCTCCGTT |
| 2518 | SPAC1687.09_UP | CACCCCGCGCTCCTTTCCTA |
| 2519 | SPAC1687.09_DN | GCCTCATGAATCCCCCCCAG |
| 2520 | SPAC1687.10_UP | TGGCGGTGGGGGGGATACTA |
| 2521 | SPAC1687.10_DN | AAGTGGGCTAATGCGGCGGC |
| 2522 | SPAC1687.12c_UP | TCATCGGAATCAACGCTCGC |
| 2523 | SPAC1687.12c_DN | CGACTTATGCGCGCGGGAGT |
| 2524 | SPAC1687.13c_UP | CCACGCGCCTACCTTCCCAG |
| 2525 | SPAC1687.13c_DN | GCTGCGGCCATCTCAACCTG |
| 2526 | SPAC1687.14c_UP | GCACGCCTAGCAGACGCACC |
| 2527 | SPAC1687.14c_DN | GGCCCAGTAGTTCCAGCGCA |
| 2528 | SPAC1687.15_UP | GCGAGGTGGATGCCGGTTGA |
| 2529 | SPAC1687.15_DN | CATTGGCCTCGATCGCGTTA |
| 2530 | SPAC1687.16c_UP | AGTTAGGGGGGCGGACTCAT |
| 2531 | SPAC1687.16c_DN | CGCCTGACCCCCTAAACCGA |
| 2532 | SPAC1687.17c_UP | CGCGTGAGGTAGTCCGGTTA |
| 2533 | SPAC1687.17c_DN | ATCTCACGCGCAAGCCTGAT |
| 2534 | SPAC1687.18c_UP | TGCAGCTGAGGATGGGACGT |
| 2535 | SPAC1687.18c_DN | GCTGGGAATTGGGCACGTGG |
| 2536 | SPAC1687.19c_UP | AGAGGAGGGCAAGGATGGGC |
| 2537 | SPAC1687.19c_DN | TCTGCGGGATGTAGGGAGCC |
| 2538 | SPAC1687.20c_UP | TTGCTCCTCCGGGCGTCTTGG |
| 2539 | SPAC1687.20c_DN | GGAGATTTGGCGAGGGCGTA |
| 2540 | SPAC16A10.01_UP | CGGCCCGAACTGTAGCGACA |
| 2541 | SPAC16A10.01_DN | CCTCATGAAGCGGGGATGCC |
| 2542 | SPAC16A10.02_UP | CCGGGCCCACTTGATGGATT |
| 2543 | SPAC16A10.02_DN | GACGCCACCACCTTCGCGAC |
| 2544 | SPAC16A10.03c_UP | ATCGCCTCTCCCACGCTCAT |
| 2545 | SPAC16A10.03c_DN | CCCCCCCGCCTATATCGTCT |
| 2546 | SPAC16A10.04_UP | TCCACCTCAGCGCAAAAGCC |
| 2547 | SPAC16A10.04_DN | CCGTCGGCGTAGCCCCATAT |
| 2548 | SPAC16A10.06c_UP | CGGCCCGGACTGTTGGAGTG |
| 2549 | SPAC16A10.06c_DN | TGGGTGGGTCGGTTCTAGGC |
| 2550 | SPAC16A10.07c_UP | CGCTTCCCCCTATTCCGTCA |
| 2551 | SPAC16A10.07c_DN | TGGATGTTGTGGTCGGGGGT |
| 2552 | SPAC16C9.02c_UP | GCGCCTGTTGGGTTTGTCGG |
| 2553 | SPAC16C9.02c_DN | GTCGCGCGGATATTCGTTTG |
| 2554 | SPAC16C9.03_UP | TAGGACACGCTGGGGGGAAT |
| 2555 | SPAC16C9.03_DN | GGCCGCTTTGCACCTTTCCC |
| 2556 | SPAC16C9.04c_UP | GCCAACACCAGAACCACGGG |
| 2557 | SPAC16C9.04c_DN | CACGGCCTTCCCTTGTCACC |
| 2558 | SPAC16C9.05_UP | TGGCTACCGCTTGACCGCAT |
| 2559 | SPAC16C9.05_DN | GATTGACACCCTTGGCGCCC |
| 2560 | SPAC16C9.06c_UP | ACAGACGGAGTTGGCGCCGA |
| 2561 | SPAC16C9.06c_DN | TGGGAAGGTGAAAACCCGCG |
| 2562 | SPAC16E8.01_UP | CCGTTAACATCCCGCACGCA |
| 2563 | SPAC16E8.01_DN | CGTCTCAGTCCGCGCATCAA |
| 2564 | SPAC16E8.04c_UP | GTGGGCGGCTTATGGGACAG |
| 2565 | SPAC16E8.04c_DN | TGTTCTAAGCTCGCGCCTGC |
| 2566 | SPAC16E8.05c_UP | GATCGCACCCCAACCGGTAA |
| 2567 | SPAC16E8.05c_DN | GTTTTTGCCTCCACGGACCT |
| 2568 | SPAC16E8.06c_UP | GACCGTTCGCTGGGGAGTGA |
| 2569 | SPAC16E8.06c_DN | AAACCCCCCCAACGTACAA |
| 2570 | SPAC16E8.09_UP | CGGCCCCGTGTTTACTCGTT |
| 2571 | SPAC16E8.09_DN | CACGCCCCGTTACCGTCATA |
| 2572 | SPAC16E8.10c_UP | TCTCCGCTCGCTGTCATTCG |
| 2573 | SPAC16E8.10c_DN | CAGGGGTCGTGCACTTGGGC |
| 2574 | SPAC16E8.12c_UP | AAAGAACCCGCGCCAAACCC |
| 2575 | SPAC16E8.12c_DN | CGTGTGTGGGGGGTGTTCT |
| 2576 | SPAC16E8.13_UP | CGTAGCACGGCCAATGGAAA |
| 2577 | SPAC16E8.13_DN | TACCCTGCCCTAACGGTCCG |
| 2578 | SPAC16E8.14c_UP | TCCATCTAACCCCGCCATCG |
| 2579 | SPAC16E8.14c_DN | TTTGCTGGGTTAGGGGGCTG |
| 2580 | SPAC16E8.15_UP | GCCCGCCTTGCTGAATGTCT |
| 2581 | SPAC16E8.15_DN | CGAAACGCAACGGAGGTCAA |
| 2582 | SPAC16E8.16_UP | GCACGCTGATGACCCCCAGA |
| 2583 | SPAC16E8.16_DN | CCAGGTAGCGCGGGGGGTAA |
| 2584 | SPAC16E8.17c_UP | GCTGCAGGTCCACTTCACAG |
| 2585 | SPAC16E8.17c_DN | CGTGTGGTGCTTGCCTTCCG |
| 2586 | SPAC16E8.18_UP | AGGGCGGCCTGAACTGGTTT |
| 2587 | SPAC16E8.18_DN | TGCCAGGCTAGGCCCCTAAT |
| 2588 | SPAC1705.02_UP | CACGGCCGGTAGATGCACAA |
| 2589 | SPAC1705.02_DN | ATTTCGGGGGTATCTCGCG |
| 2590 | SPAC1751.01c_UP | ACCCCCGATGTCCCCTACAA |
| 2591 | SPAC1751.01c_DN | ATGGCGATTGGGGAGAGACG |
| 2592 | SPAC1751.02c_UP | CGGGTGCGTGAGCCTGATAA |
| 2593 | SPAC1751.02c_DN | CCTCGTTCCCACGTCTTCCG |
| 2594 | SPAC1751.04_UP | TGTCTCTTAGGCGACCTGCG |
| 2595 | SPAC1751.04_DN | TACACGTATGACTGGCCGGG |
| 2596 | SPAC1782.02c_UP | TCCACTTCGCACCCGCTTTG |
| 2597 | SPAC1782.02c_DN | GGGGGGTGGCCATATATCG |
| 2598 | SPAC1782.03_UP | GGTCGTCGAGTTGGGGGCTG |
| 2599 | SPAC1782.03_DN | CCGGCTTGCTTTTGGGAGCT |
| 2600 | SPAC1782.05_UP | AGGTCGGAGCAAGGCAGGTG |
| 2601 | SPAC1782.05_DN | GCAGGCGCGTTGGGCTTATC |
| 2602 | SPAC1782.06c_UP | AGTAGGACTCGGGGGCGGTG |
| 2603 | SPAC1782.06c_DN | TTTGGGGGAGGGTTGAATGG |
| 2604 | SPAC1782.07_UP | TTGGGCTACCTTGGCATCGG |
| 2605 | SPAC1782.07_DN | TTTGCGGAGGGGGGAGACAG |
| 2605 | SPAC1782.08c_UP | GCAGCCTTCGGCTAGCTCAT |
| 2607 | SPAC1782.08c_DN | AAAGGCGATTCGCTGGCACA |
| 2608 | SPAC1782.09c_UP | GACATTTTGGCGGGCGGAGA |
| 2609 | SPAC1782.09c_DN | GCGGATGGGGGTGTTGGGAC |
| 2610 | SPAC1782.10c_UP | AGGATGTGGGGGCTACGGGT |
| 2611 | SPAC1782.10c_DN | AAGGTGGGCAGGGGCAAATC |
| 2612 | SPAC1782.12c_UP | TCCCGCCACCGTCTGTTTGC |
| 2613 | SPAC1782.12c_DN | AGCTAGCGTCAGCGACTGAG |
| 2614 | SPAC1783.01_UP | AGTCTCGGTTCGCGTGCCCA |
| 2615 | SPAC1783.01_DN | AAGCCTAGGTCCCCCCGCAC |
| 2616 | SPAC1783.02c_UP | CCGGTCCACGATCTTCACTC |
| 2617 | SPAC1783.02c_DN | TATAAGGCGCCAATCCCCGA |
| 2618 | SPAC1783.03_UP | CCGTTCGTTTATTCGCCCGT |
| 2619 | SPAC1783.03_DN | AGCGAGGCGAACAGGCGAGG |
| 2620 | SPAC1783.05_UP | ATCCCACCCGCCATGAAGAC |
| 2621 | SPAC1783.05_DN | GCGTTCTCCGGCACATGTTG |
| 2622 | SPAC1783.06c_UP | TGCATATCTCGATCGCGGCA |
| 2623 | SPAC1783.06c_DN | ACGAATCCGCACGAACCCCT |
| 2624 | SPAC1783.07c_UP | CCCGTTGTTCGTCTCCCCTG |
| 2625 | SPAC1783.07c_DN | TGTTTAGGCGATGGGCGGTG |
| 2626 | SPAC1783.08c_UP | CTCTCAATAAGGGCGCCGGA |
| 2627 | SPAC1783.08c_DN | GCACCGATCGCCTAGGAACC |
| 2628 | SPAC1786.02_UP | GCCAGCCAACGACCAATCCG |
| 2629 | SPAC1786.07_DN | GGGCTTTGGTATCGCTGGGG |
| 2630 | SPAC1786.04_UP | TAGCGCTGCCGGACGTAGTA |
| 2631 | SPAC1786.04_DN | TCACGGGCTAGTCCTTCCCA |
| 2632 | SPAC17A2.01_UP | GGTCTAAGCGGCGTCCCACA |
| 2633 | SPAC17A2.01_DN | CCGTCGTGGGCGTGATAGGG |
| 2634 | SPAC17A2.02c_UP | TAGGCTGATTTGGCGGGCAT |
| 2635 | SPAC17A2.02c_DN | CTGGGAGGAGTGCCGAACGGC |
| 2636 | SPAC17A2.03c_UP | TGTCATTCGGGCAGGTCGGC |
| 2637 | SPAC17A2.03c_DN | GGTTGCGGGTCTGTTGGAAG |
| 2638 | SPAC17A2.04c_UP | GAGCGCGCGACGAAGATCTA |
| 2639 | SPAC17A2.04c_DN | ACTGCAACGGCTGGTGGGCT |
| 2640 | SPAC17A2.05_UP | CGGCCGCATCCTCTTTGAGT |
| 2641 | SPAC17A2.05_DN | CGGCTTCCCTCCCGTTGACT |
| 2642 | SPAC17A2.06c_UP | GGCGGTAACAAGCGGGTCAG |
| 2643 | SPAC17A2.06c_DN | CGCTGGCCGGCTGACTTTAA |
| 2644 | SPAC17A2.07c_UP | CCCCCTCGGCCACTCTAACG |
| 2645 | SPAC17A2.07c_DN | CTGTAGGCGGGAAGCGGGTC |
| 2646 | SPAC17A2.08c_UP | CGGGCGCACATTCTGAGCTG |
| 2647 | SPAC17A2.08c_DN | CCGAATGGAGACAGGCCACC |
| 2648 | SPAC17A2.09c_UP | CCTGCGCCACCTTGACACGA |
| 2649 | SPAC17A2.09c_DN | CAGTTCCGGGCGCACAAACC |
| 2650 | SPAC17A2.10c_UP | ACACACCCTCGCATGCCAAA |
| 2651 | SPAC17A2.10c_DN | GGGGGACGGTGTGGGGAGAG |
| 2652 | SPAC17A2.11_UP | CGCCGCCCATCGCTCCAATAA |

FIG.20

| Sequence number | Name | Base sequence |
|---|---|---|
| 2653 | SPAC17A2.11_DN | TTTGGGGAAGGTCGTGGGCC |
| 2654 | SPAC17A2.12_UP | CCAGGCCTCTTCAACCCGCC |
| 2655 | SPAC17A2.12_DN | GTGCCTTTGCGGGTGTTGCT |
| 2656 | SPAC17A2.13a_UP | TGTTTGGGCCTCATGGCAGC |
| 2657 | SPAC17A2.13a_DN | CCATCACCCGTTTGAGCGAA |
| 2658 | SPAC17A5.01_UP | CGCCAACATAAGCTCCCCGC |
| 2659 | SPAC17A5.01_DN | ATGGCGGTGGGGCAAGTCAG |
| 2660 | SPAC17A5.02a_UP | AACCCCAGACGCCAAAGCCA |
| 2661 | SPAC17A5.02a_DN | CATCATCCACCCCCACGGCT |
| 2662 | SPAC17A5.03_UP | GACTGGGGAACCTCGGGACG |
| 2663 | SPAC17A5.03_DN | ATTGCCCTCCCACACGAAG |
| 2664 | SPAC17A5.04a_UP | GTGGGCATTTTTCGCTTGGC |
| 2665 | SPAC17A5.04a_DN | TGCTTGCCCGAGACCCTGTC |
| 2666 | SPAC17A5.05a_UP | CCCGCCCAAAGTCTGCCCTC |
| 2667 | SPAC17A5.05a_DN | CGATGCACCACAXXTACXX |
| 2668 | SPAC17A5.06_UP | AGCTTTTGATCGCGCGGAG |
| 2669 | SPAC17A5.06_DN | GGCGCGGCTGTCTTCTTGT |
| 2670 | SPAC17A5.09a_UP | GTGTACATGTCTGCGGCGGG |
| 2671 | SPAC17A5.09a_DN | GTGTGTGATGGAGGCCCGTG |
| 2672 | SPAC17A5.10_UP | TCAGAAACCAGATCGGGGCG |
| 2673 | SPAC17A5.10_DN | TTGATAATTGCCGGTGCCCC |
| 2674 | SPAC17A5.11_UP | GCTTCTAGATCGGGGCGCAC |
| 2675 | SPAC17A5.11_DN | CCAAACATACCCGTGCGCG |
| 2676 | SPAC17A5.12_UP | CCACTTCAATCCCCGCACCG |
| 2677 | SPAC17A5.12_DN | CGCGAACCCACCAAAGCCT |
| 2678 | SPAC17A5.14_UP | CCCTCCGCTTCGCCCTGTAG |
| 2679 | SPAC17A5.14_DN | GGATGAGGGGACCGGGAGCT |
| 2680 | SPAC17A5.16_UP | TCCGGCGGTAGGCGGACAGT |
| 2681 | SPAC17A5.16_DN | CATGTTGGGGCGCGATTTGA |
| 2682 | SPAC17A5.18a_UP | CGCTCTGATCAGTGAGCCCT |
| 2683 | SPAC17A5.18a_DN | CCGTGTTGCAGTGCCGGATA |
| 2684 | SPAC17C9.02a_UP | ACATTTTGGGGGTGGTTCG |
| 2685 | SPAC17C9.02a_DN | CGAGAGGCCAACAGCGGGA |
| 2686 | SPAC17C9.05a_UP | TCCCCGAACGGTAATCTGCA |
| 2687 | SPAC17C9.05a_DN | TTATTGCGGGCGGCGGTTAT |
| 2688 | SPAC17C9.07_UP | ACAGAGCGTGGCCGAGGTGG |
| 2689 | SPAC17C9.07_DN | ACCCCCGACCAACGCACACA |
| 2690 | SPAC17C9.08_UP | GATGAGTGCGGTGAACGGGG |
| 2691 | SPAC17C9.08_DN | CCACTCCGGTTCCCTTTCGT |
| 2692 | SPAC17C9.09a_UP | ATCACACCGTGCGTATCCCG |
| 2693 | SPAC17C9.09a_DN | ACGAGGCCCTAGTGAGGCAA |
| 2694 | SPAC17C9.10_UP | CTACGGAGGAGGGGATGCGA |
| 2695 | SPAC17C9.10_DN | GCCCCGTGACAGCCCAATTT |
| 2696 | SPAC17C9.11a_UP | CTTTGGGAGATGCTGCGCGG |
| 2697 | SPAC17C9.11a_DN | CAGTAACGGCCTCATGCCCA |
| 2698 | SPAC17C9.12_UP | CCGCGCCAGTAGAGGAGAA |
| 2699 | SPAC17C9.12_DN | TGGAAGAGAGCGGATGGGC |
| 2700 | SPAC17C9.13a_UP | GCGGTCGAGGGGAAACGGG |
| 2701 | SPAC17C9.13a_DN | AGCTCCTCCCCCCTCGGTAA |
| 2702 | SPAC17C9.14_UP | CCAAATCGCTAGCACGCCG |
| 2703 | SPAC17C9.14_DN | ACGGGTCATGTTGGGGGTGT |
| 2704 | SPAC17C9.15a_UP | CCAAATTCGCTGCTTGCCAG |
| 2705 | SPAC17C9.15a_DN | TAGCTGCGTGGGGGATTCA |
| 2706 | SPAC17C9.16a_UP | AAGTCTCGTTGACACGTCCC |
| 2707 | SPAC17C9.16a_DN | CACTTACTGGGCACCCGCTT |
| 2708 | SPAC17D4.02_UP | CGGCAGCACCCTTGCCCGAG |
| 2709 | SPAC17D4.02_DN | TCAATGCGGGGGAAACAGCG |
| 2710 | SPAC17D4.03a_UP | GGAAAGGTTGGCTTGAGGGAT |
| 2711 | SPAC17D4.03a_DN | CCACCCACCTCCTGCTCCGCT |
| 2712 | SPAC17G6.02a_UP | CCGGGCAATTTCTCCCTGAT |
| 2713 | SPAC17G6.02a_DN | CGTCAAGTAGTCAGGCCCGT |
| 2714 | SPAC17G6.03_UP | CAACAACGCGCCAGAGAAGG |
| 2715 | SPAC17G6.03_DN | CCCTCGGCCAACGAAACGAT |
| 2716 | SPAC17G6.05a_UP | ATTGAAGGCCCCTACGCCCC |
| 2717 | SPAC17G6.05a_DN | AGTTGCAGGCGGGCATGTGA |
| 2718 | SPAC17G6.06_UP | AGACACGCCTACGCCGAGCC |
| 2719 | SPAC17G6.06_DN | TTTCAAGGGTTTCGTGCCGC |
| 2720 | SPAC17G6.07a_UP | TAGGTTGGACAGTCGAGCG |
| 2721 | SPAC17G6.07a_DN | ACACCCGCTGCGAAAGCCACG |
| 2722 | SPAC17G6.08_UP | GCCCCTCAGTGCCCCTCCAA |
| 2723 | SPAC17G6.08_DN | TGAACTATCCCCATCGCCCC |
| 2724 | SPAC17G6.10_UP | AGGCGACGTGCACGGTAATG |
| 2725 | SPAC17G6.10_DN | GCGAGAGGGCATCATAGCGG |
| 2726 | SPAC17G6.12_UP | CATTTACAAGCCCGCGGAG |
| 2727 | SPAC17G6.12_DN | TTCAGACCCCCACCCAACCC |
| 2728 | SPAC17G6.13_UP | CATCGTGGGCCTTCCGGGTC |
| 2729 | SPAC17G6.13_DN | TATTTGCGCGCTCACTCGTT |
| 2730 | SPAC17G6.14a_UP | TTCTGGCGGCTCTTGCTGGG |
| 2731 | SPAC17G6.14a_DN | TTGTTGCCTGCCGCACCGTC |
| 2732 | SPAC17G6.15a_UP | CGCCAATCCCAACTCGCCCT |
| 2733 | SPAC17G6.15a_DN | CGACGGCTTTTATGGCACGC |
| 2734 | SPAC17G6.16a_UP | ACTGGGCGCCAAGTTCGAAT |
| 2735 | SPAC17G6.16a_DN | ACCGTGGAGCCCTTGCTTG |
| 2736 | SPAC17G6.17_UP | AACCCATCCCCGCAACCTAG |
| 2737 | SPAC17G6.17_DN | CGTGGGATGCGGATATTGC |
| 2738 | SPAC17G8.02_UP | CCCCACCGACGTACCAAGCC |
| 2739 | SPAC17G8.02_DN | GCGGGAGGTGCAACGAGATG |
| 2740 | SPAC17G8.03a_UP | CTGTGGACGTGCTGCGGCTC |
| 2741 | SPAC17G8.03a_DN | GGGCGGCACTAGGGGGAAATC |
| 2742 | SPAC17G8.04a_UP | TGGTCGGCTTGGAATCGGG |
| 2743 | SPAC17G8.04a_DN | TGGACACAGGGGGCCGAGTT |
| 2744 | SPAC17G8.07_UP | TTGCAACACAACCCACACCC |
| 2745 | SPAC17G8.07_DN | GCCGGGCGAAGCTGAACCT |
| 2746 | SPAC17G8.08a_UP | CCGCCACGCCACCTATTCTC |
| 2747 | SPAC17G8.08a_DN | TCTGTCCCCGTGCTGCCATA |
| 2748 | SPAC17G8.11a_UP | AAGCAGGGTAAGCGGGGGAG |
| 2749 | SPAC17G8.11a_DN | CAGCTGCCCAACATTTCCGC |
| 2750 | SPAC17G8.12_UP | CGTAATGCGCTCGCCGAAGT |
| 2751 | SPAC17G8.12_DN | AATTTGCCGCCCTACTCCG |
| 2752 | SPAC17G8.13a_UP | ACAGAGCGGGGACCAGGGAG |
| 2753 | SPAC17G8.13a_DN | CCAGCCAAGCCCGTACATGC |
| 2754 | SPAC17H9.01_UP | CCCCGGATGAGAAAAGGCGT |

| Sequence number | Name | Base sequence |
|---|---|---|
| 2755 | SPAC17H9.01_DN | ACTTGGCAGGCGTCGGGTTG |
| 2756 | SPAC17H9.02_UP | GGGATGCGGAATGGGATGGC |
| 2757 | SPAC17H9.02_DN | AAACGGAAAAGCAGCGGGTG |
| 2758 | SPAC17H9.03a_UP | CGGTATGGGGTGGCTTCGTG |
| 2759 | SPAC17H9.03a_DN | AATCCTGTTGCTCGGGGTGC |
| 2760 | SPAC17H9.04a_UP | TCGGATGCGCCTCACCCTA |
| 2761 | SPAC17H9.04a_DN | TCGCAAGCCGGTCCCCTAAT |
| 2762 | SPAC17H9.06a_UP | GGGCGGGACTTGTCTTGGCT |
| 2763 | SPAC17H9.06a_DN | AGCAAGCAAGCAAAGCCGCC |
| 2764 | SPAC17H9.08_UP | AGGCGCGGCTGACTTACTCA |
| 2765 | SPAC17H9.08_DN | TGCGGCCAGCTGACGTTCAT |
| 2766 | SPAC17H9.09a_UP | TGTATGACCCCGCTCCCGA |
| 2767 | SPAC17H9.09a_DN | GAGAATTGGTGGACGGGGGG |
| 2768 | SPAC17H9.10a_UP | ATTCACTGTCCCCCGGCTG |
| 2769 | SPAC17H9.10a_DN | TGCCTAGLACCCCTCGAGCC |
| 2770 | SPAC17H9.11_UP | AGAACACGGGCAGCCAGAGCG |
| 2771 | SPAC17H9.11_DN | CCGGCCCCTCAAGTGATCGT |
| 2772 | SPAC17H9.12a_UP | TCGTCCCATCCAACCCCTCC |
| 2773 | SPAC17H9.12a_DN | CATCCCGGCTCCTCGTCCGC |
| 2774 | SPAC17H9.13a_UP | AGAACATGCTGGGGTGGGCG |
| 2775 | SPAC17H9.13a_DN | CATCCGGCTTCGGCCATCTT |
| 2776 | SPAC17H9.14a_UP | CGGTCCCGCTCCTCTCACTG |
| 2777 | SPAC17H9.14a_DN | CCCACCCAAGCGCACCTAAC |
| 2778 | SPAC17H9.16_UP | AGCCCCGAAACCACAGCGTA |
| 2779 | SPAC17H9.16_DN | AACAACAGCGAACCAGCGCC |
| 2780 | SPAC17H9.17a_UP | CAACAACTGGGCGCCGGATAA |
| 2781 | SPAC17H9.17a_DN | CGCGCGGGTTTCTCCCCTAAT |
| 2782 | SPAC17H9.18a_UP | CGGTTCGGTCTTCGTGCGTG |
| 2783 | SPAC17H9.18a_DN | CGCGTTTCACATCCTTGGGC |
| 2784 | SPAC17H9.19a_UP | TGAGGGATGGAATGCCGGTG |
| 2785 | SPAC17H9.19a_DN | TTTTGGATACCGTCCCCCGG |
| 2786 | SPAC1805.02a_UP | AGCAGTCGGCGGCATTTTGG |
| 2787 | SPAC1805.02a_DN | ATACCCAGGTCGGTTTCGCG |
| 2788 | SPAC1805.04_UP | TACAGCGTGGCACACTCGTC |
| 2789 | SPAC1805.04_DN | ACCCAGCCGCTAGATCTGCCA |
| 2790 | SPAC1805.05_UP | CGTGCCCATTTTCCCAGCC |
| 2791 | SPAC1805.05_DN | TGTGTCCCGTCCCTTTGGCG |
| 2792 | SPAC1805.06a_UP | GTGGGGCGACTGCTGTTGGT |
| 2793 | SPAC1805.06a_DN | GGGGCGTTTGCAGGGGTAGG |
| 2794 | SPAC1805.07a_UP | TACCTGGGCGTGCACTTTCG |
| 2795 | SPAC1805.07a_DN | TCAGATCGCCCCTCACCAGC |
| 2796 | SPAC1805.09a_UP | CGCCCAACCCCCCTATCCTT |
| 2797 | SPAC1805.09a_DN | AGGCGTGGCGTGTGGTCTCG |
| 2798 | SPAC1805.10_UP | GTCTGTCATCGCGGGCCCTC |
| 2799 | SPAC1805.10_DN | GGGCGCCGGCAAAACCTATA |
| 2800 | SPAC1805.11a_UP | CCGACCCGTTAAGGCCAAAG |
| 2801 | SPAC1805.11a_DN | CCGACCTCCACTTAAGCCCA |
| 2802 | SPAC1805.12a_UP | ACGGCCAGCCTGACTAACGA |
| 2803 | SPAC1805.12a_DN | CGCCCCAACGCACCACTCTT |
| 2804 | SPAC1805.15a_UP | AGGAGGAGAGGGAAGGCGGG |
| 2805 | SPAC1805.15a_DN | CACTTGAACCCACCCCCCCA |
| 2806 | SPAC1805.16a_UP | CAGGCGCCCAGGAAACACCA |
| 2807 | SPAC1805.16a_DN | ACTTGACATGGAGGCCCTGG |
| 2808 | SPAC1834.01_UP | CCATAAAAGGGCTCCCGGCAA |
| 2809 | SPAC1834.01_DN | CCGCCGAGCGAATGTCAAGT |
| 2810 | SPAC1834.03a_UP | GCGGGGGCCTACTCATGAGG |
| 2811 | SPAC1834.03a_DN | TTGCACCCAGCTCGTCGTCG |
| 2812 | SPAC1834.04_UP | CGCACATGGGGGTCICGGATT |
| 2813 | SPAC1834.04_DN | CGCCCGCGATAAAGCGAACA |
| 2814 | SPAC1834.05_UP | CGGCCGATTACGGTCACGT |
| 2815 | SPAC1834.05_DN | CACCCCCGGTACGCAACCACT |
| 2816 | SPAC1834.06a_UP | AATGGACCCACACCCTTCGG |
| 2817 | SPAC1834.06a_DN | CCCGTGTCGGCTCAGGTGTC |
| 2818 | SPAC1834.07_UP | TACGCACCCCTCGCCTTACC |
| 2819 | SPAC1834.07_DN | GGGGGGTGTCAAGGGACGGT |
| 2820 | SPAC1834.08_UP | TGTCTTCCTCCCCCCATGTC |
| 2821 | SPAC1834.08_DN | GCGCGATGAAGGGAGGGAG |
| 2822 | SPAC1834.09_UP | AAATGCCGTAGGGCGAGGGG |
| 2823 | SPAC1834.09_DN | GAGCCTTTGTTCCCCCCGA |
| 2824 | SPAC1834.10a_UP | TGGTGTTGGTCGCGCTTTT |
| 2825 | SPAC1834.10a_DN | ATGCTCGCGTTTTCTCCCA |
| 2826 | SPAC4H3.09_UP | ACCAAACCAAGGCCACCCAA |
| 2827 | SPAC4H3.09_DN | ACGATGAAGGGGCGGGGACCT |
| 2828 | SPAC1851.03_UP | CCAGCCGCCAGCACAAATCC |
| 2829 | SPAC1851.03_DN | CTCCGCACCTCGCCTCAGAA |
| 2830 | SPAC186.01_UP | TACCTGGCGCTTGAATCCG |
| 2831 | SPAC186.01_DN | GACCAACCTTAGCCCGCTAC |
| 2832 | SPAC186.02a_UP | CCGCTCGTCCCTCTTTCCTG |
| 2833 | SPAC186.02a_DN | TGCAGCCACAAACCCAAGCG |
| 2834 | SPAC186.03_UP | ATACAAGATCCGGCCGTGGG |
| 2835 | SPAC186.03_DN | GTGGCGGTTGTTCTTGCGTG |
| 2836 | SPAC186.05a_UP | TCGGATGTAAGCGTTGGCCC |
| 2837 | SPAC186.05a_DN | GCCATTCTGCCGGGACTCAC |
| 2838 | SPAC186.06_UP | TCCCGTCATAGCCCTTCCCG |
| 2839 | SPAC186.06_DN | AATGGGCGGGGAGTAGGGAA |
| 2840 | SPAC186.07a_UP | CCGTTGCCGTGTGTATGCGT |
| 2841 | SPAC186.07a_DN | TGCTTGCGGCGACGGTAGGT |
| 2842 | SPAC186.08a_UP | AAATCCCGCTCCTCCCCCTA |
| 2843 | SPAC186.08a_DN | AGGGGGATTAGCGGTGCAGG |
| 2844 | SPAC186.09_UP | GCGCTGCACCCCGACAAATC |
| 2845 | SPAC186.09_DN | TGCTCTCCGTCCTTACCCGC |
| 2846 | SPAC18B11.02a_UP | AGTTGGGGCAGCGTGGTGAA |
| 2847 | SPAC18B11.02a_DN | TAGGGGATATTCGGACGCGG |
| 2848 | SPAC18B11.03a_UP | CAATCCTCCACCACCACGCA |
| 2849 | SPAC18B11.03a_DN | CGGGGCGGCAATCGATAAAA |
| 2850 | SPAC18B11.04_UP | ACCCCTCTGCACCAATGCCG |
| 2851 | SPAC18B11.04_DN | ATGCCCAAAGACCGCCCCTG |
| 2852 | SPAC18B11.06_UP | TGACCCCGCTTTGTTGAGCC |
| 2853 | SPAC18B11.06_DN | GGCATAACTCAGGGGCAGCG |
| 2854 | SPAC18B11.07a_UP | GCTGCGGGGATTGGAGGAC |
| 2855 | SPAC18B11.07a_DN | TCTGGTGGTTGGTGCGTGCC |
| 2856 | SPAC18B11.10_UP | CGCGATGTTACGGGGCTACG |

FIG.21

| Sequence number | Name | Base sequence |
|---|---|---|
| 2857 | SPAC18B11.10_DN | CCCGCGTGTCTGCTGCAATA |
| 2858 | SPAC18G6.01c_UP | CTGGGCTCGTTGGCTGATCA |
| 2859 | SPAC18G6.01c_DN | ACAACAAGGCGGCGAGAGGT |
| 2860 | SPAC18G6.02c_UP | AAGTGTGGGCTCGTGGGCGG |
| 2861 | SPAC18G6.02c_DN | AAATGAGCGGTTGCGGTCGT |
| 2862 | SPAC18G6.03_UP | TAAATCGGGGCTTCACGGCT |
| 2863 | SPAC18G6.03_DN | ACGCACCAACTCCGCCGAAT |
| 2864 | SPAC18G6.04c_UP | TCACTTCGCCGACTTCGGCT |
| 2865 | SPAC18G6.04c_DN | TACCTGTTCTGTCGCCGCGC |
| 2866 | SPAC18G6.05c_UP | ACGGGCGGTGGTGATTTGCT |
| 2867 | SPAC18G6.05c_DN | AAATGCTGGGGGTCGTGGCT |
| 2868 | SPAC18G6.07c_UP | CAACAGGGGCGTAAGACCAG |
| 2869 | SPAC18G6.07c_DN | GTCTGGGTGGTGCGTGTCGC |
| 2870 | SPAC18G6.10_UP | TTCTTACCGGCCTGTGCCGA |
| 2871 | SPAC18G6.10_DN | CGCTATTGCGTTGGATCCGA |
| 2872 | SPAC18G6.12c_UP | CAGGGGGAGGTCGTATGGCC |
| 2873 | SPAC18G6.12c_DN | ATTGGGTACGGCGCAGGGTT |
| 2874 | SPAC18G6.13_UP | TTTGTTTTCGGGTGCGGATG |
| 2875 | SPAC18G6.13_DN | CACCACCAACCGCGCCATAG |
| 2876 | SPAC18G6.14c_UP | ACTGGGAACGGCAAGGGGGT |
| 2877 | SPAC18G6.14c_DN | ATTCGCTCCCTCTGCCGGGT |
| 2878 | SPAC18G6.15_UP | ATCGCGGCATATACCCCTGC |
| 2879 | SPAC18G6.15_DN | GAAATTGCGACCTGGCGGTG |
| 2880 | SPAC1952.03_UP | ACACGACGCTCCTTCGCAAA |
| 2881 | SPAC1952.03_DN | CGTACAAATGGGGGCGGACA |
| 2882 | SPAC1952.05_UP | CGCGGCACATTCCACCCTTC |
| 2883 | SPAC1952.05_DN | ACTTCATTCCTGCATCGGGG |
| 2884 | SPAC1952.06c_UP | CAGTGCCCTCCGTTGACCGT |
| 2885 | SPAC1952.06c_DN | CGTGGGCAGGACAGAAGCAG |
| 2886 | SPAC1952.07_UP | TTTGTCCGGTCTTTCGCGCG |
| 2887 | SPAC1952.07_DN | GGCTCCCGGTTCGCTTATTG |
| 2888 | SPAC1952.09c_UP | TGGGAAACCTGGTGGGGTGA |
| 2889 | SPAC1952.09c_DN | CCCTTCGCTGTTTCGGTTCC |
| 2890 | SPAC1952.09c_UP | AGACACTTGGCCAAGAGAG |
| 2891 | SPAC1952.09c_DN | GTATGCCGCTAACGCCGAGA |
| 2892 | SPAC1952.10c_UP | AGTTAGGCGTTGGCGTTGGCC |
| 2893 | SPAC1952.10c_DN | ATGCGGCCGGAATTTGTGTG |
| 2894 | SPAC1952.11c_UP | CCAGGGGCAACGATTAACGC |
| 2895 | SPAC1952.11c_DN | CGTTCCGTGCGCTTCCTATG |
| 2896 | SPAC1952.12c_UP | ACTATCACAAAGCGGCGGCA |
| 2897 | SPAC1952.12c_DN | CCGCAGCACCCCAACACTCT |
| 2898 | SPAC1952.13_UP | GTGCCGTCTTTGGCAGGCAG |
| 2899 | SPAC1952.13_DN | AGACGCCCGTTGCGGATTGA |
| 2900 | SPAC1952.14c_UP | CCACCGCGATCAACCCGAGA |
| 2901 | SPAC1952.14c_DN | CGTTCTGCCTCCCACCACCT |
| 2902 | SPAC1952.15c_UP | TGACATGTACCGCGAAGGCCG |
| 2903 | SPAC1952.15c_DN | TCCCTGAGCCCACAAACCCT |
| 2904 | SPAC1952.16_UP | GGTTGCCCAGGCTGATCCGA |
| 2905 | SPAC1952.16_DN | GTGCCGTTGTGGGCCCCTCT |
| 2906 | SPAC19A8.02_UP | CAGCCTCCCGCCTTCACGAC |
| 2907 | SPAC19A8.02_DN | GCTTCAGCGACTCGGATCGT |
| 2908 | SPAC19A8.03_UP | CGGGTCAAAACTGGGGGCAA |
| 2909 | SPAC19A8.03_DN | AAAATCTACCATGGGCCGCG |
| 2910 | SPAC19A8.04_UP | TCCCCGGAAGTTTGGAGCCC |
| 2911 | SPAC19A8.04_DN | ACCGGGAGGGCTTGGGAATC |
| 2912 | SPAC19A8.05c_UP | CCACGGACGTAGTCCGCAAT |
| 2913 | SPAC19A8.05c_DN | GATTTTAGCGCGCGTCCATG |
| 2914 | SPAC19A8.07c_UP | GTAGGCAATTGGGAGGCGAG |
| 2915 | SPAC19A8.07c_DN | ATGACCGCACACCCTGCTCCC |
| 2916 | SPAC19A8.08_UP | TCTCACAAGGGCTCACGCGA |
| 2917 | SPAC19A8.09_UP | GCCTTCCAGCAGTCCGGTCC |
| 2918 | SPAC19A8.09_DN | GCCTGGTGGCGCGTTTTTCA |
| 2919 | SPAC19A8.09_DN | TCAAGGGGTGCGCGGGTAGA |
| 2920 | SPAC19A8.10_UP | CTACACGCGTCACAAGCGCAT |
| 2921 | SPAC19A8.10_DN | TGGCGTGGCTCTCAAATGGA |
| 2922 | SPAC19A8.12_UP | TCAGCCACGGCAAGCCCATC |
| 2923 | SPAC19A8.12_DN | AGGGTGGTGGCGACGAACAA |
| 2924 | SPAC19A8.13_UP | GTGCTGCGCCGGAAGAAAAG |
| 2925 | SPAC19A8.13_DN | TTTCCACGCCGGACCCACAGAC |
| 2926 | SPAC19A8.14_UP | CGTGCCACCCAATGACAACT |
| 2927 | SPAC19A8.14_DN | GCCTGTGTCTTCGGGGATCG |
| 2928 | SPAC19B12.02c_UP | CGGTTGGGAAGTTGGGTGCC |
| 2929 | SPAC19B12.02c_DN | AGATACTCTCTTCGGCCGCG |
| 2930 | SPAC19B12.04_UP | AAATGTCGAGCGGAGGGGTG |
| 2931 | SPAC19B12.04_DN | CAGCCGGACGAATGGAAAC |
| 2932 | SPAC19B12.05c_UP | TTTCCCGCCACCTTCCAGTC |
| 2933 | SPAC19B12.05c_DN | GGGGAGCTTTCCAGTGGGGT |
| 2934 | SPAC19B12.06c_UP | ACCAACACCGCCCCGTAAAC |
| 2935 | SPAC19B12.06c_DN | CCACCCACATCGCCTCTCGT |
| 2936 | SPAC19B12.07c_UP | GCTCCTGACTGTACGCGAGA |
| 2937 | SPAC19B12.07c_DN | GCTGGAAAATCCGTTGTCCG |
| 2938 | SPAC19B12.08_UP | GAACTGCCAATGCCCCTCGG |
| 2939 | SPAC19B12.08_DN | CGAGCTCCTCTCALTGGGCG |
| 2940 | SPAC19B12.09_UP | CCTAGAACCCATGCGCCTCG |
| 2941 | SPAC19B12.09_DN | TGGGGGGATTTGCAACGGTA |
| 2942 | SPAC19B12.10_UP | TTACACGTCCGCGGGGCCAA |
| 2943 | SPAC19B12.10_DN | CTGATGTTGGGAGCACGCGC |
| 2944 | SPAC19B12.11c_UP | AGAAGCGAGGGGGACAGCGG |
| 2945 | SPAC19B12.11c_DN | GGCTAGCCGAAGGGCACGTC |
| 2946 | SPAC19B12.12c_UP | GCTGGCGGTTAAAGGGCTG |
| 2947 | SPAC19B12.12c_DN | TTAACTATGACGGGGGCGGG |
| 2948 | SPAC19B12.13_UP | TGAGCGGCCGGAGGTTATGG |
| 2949 | SPAC19B12.13_DN | GTACGAATCCCAACCCGGCG |
| 2950 | SPAC19D5.01_UP | CTCATCCCGCCCCATTGCTT |
| 2951 | SPAC19D5.01_DN | GCGGGGGGTAATCAAATGG |
| 2952 | SPAC19D5.02c_UP | CACGCGTCCCCACCCTTCTG |
| 2953 | SPAC19D5.02c_DN | TCCGTTCAGGGAGCAGGGTT |
| 2954 | SPAC19D5.03_UP | CGCGAATGACGGGACTACCA |
| 2955 | SPAC19D5.03_DN | TGAACTCTTAGCGTGCCCCG |
| 2956 | SPAC19D5.04_UP | TGGGTCGGTGGGCGAATAAGA |
| 2957 | SPAC19D5.04_DN | CCTCTCTTGCTTCGCCTCCG |
| 2958 | SPAC19D5.05c_UP | GGGGGCCGCGATAGTCACTG |

| Sequence number | Name | Base sequence |
|---|---|---|
| 2959 | SPAC19D5.05c_DN | GTTAACGGCCACTCCGCCCA |
| 2960 | SPAC19D5.06c_UP | AAGGGCGCGGGTGTTTGTAA |
| 2961 | SPAC19D5.06c_DN | GAGCCAACCCCACGACCAAG |
| 2962 | SPAC19D5.07_UP | GGCGGCCGTGAGAGGAAGAG |
| 2963 | SPAC19D5.07_DN | CAGTCGAGGGCGGGGATTTC |
| 2964 | SPAC19D5.09c_UP | CACAGTCCCCGATCCAGCAA |
| 2965 | SPAC19D5.09c_DN | GACAGGTTCAGGCCAGCGGT |
| 2966 | SPAC19D5.10c_UP | TGCGACGCGCGATCTACTGT |
| 2967 | SPAC19D5.10c_DN | ATGCCGCCTACGGACGTACA |
| 2968 | SPAC19D5.11c_UP | GCGCCCTAGTACGTGTCCAT |
| 2969 | SPAC19D5.11c_DN | ACGACTACCAGAGGCCCGAT |
| 2970 | SPAC19E9.01c_UP | GGGCCAGTCCCACGTTTACA |
| 2971 | SPAC19E9.01c_DN | AGCCGAAGGCGCATTTGAGC |
| 2972 | SPAC19E9.02_UP | GGCCCCACCCAACTCGCTGT |
| 2973 | SPAC19E9.02_DN | TGCAGGTCTTGGGGTCGTC |
| 2974 | SPAC19G12.01c_UP | TGGCTGGATTTGGTTCGGGA |
| 2975 | SPAC19G12.01c_DN | CTGTTCCCACTCGGCCCTCG |
| 2976 | SPAC19G12.02c_UP | CATTGCGTAGGCTGCGGACA |
| 2977 | SPAC19G12.02c_DN | CGTGGATGCGGGGAAACGAC |
| 2978 | SPAC19G12.03_UP | GAACCCCACCCCAGCGAAAT |
| 2979 | SPAC19G12.03_DN | CGCTTGAGTGCCCGATGAAG |
| 2980 | SPAC19G12.04_UP | CGCCCAATAGGTCTTCGCCC |
| 2981 | SPAC19G12.04_DN | CCACGCGTCTGTAATGCCCG |
| 2982 | SPAC19G12.05_UP | TGATTCTCGGGCTGGTGTGC |
| 2983 | SPAC19G12.05_DN | TGTCTCGTCATCCTACCCGC |
| 2984 | SPAC19G12.06c_UP | CTGGGGACAACCGAAGGCGA |
| 2985 | SPAC19G12.06c_DN | AGCTGGGGCCTTGTCACGTG |
| 2986 | SPAC19G12.08_UP | CAGCACCCCCATCCCCTTTG |
| 2987 | SPAC19G12.08_DN | TGGATGGCGCTATGGTGTGG |
| 2988 | SPAC19G12.09_UP | ATCGTCGCTCACCCTCTCGG |
| 2989 | SPAC19G12.09_DN | CCTTTCCTTCCATCGCGCAG |
| 2990 | SPAC19G12.10c_UP | ATGACAGAAGCGGCAGGCAA |
| 2991 | SPAC19G12.10c_DN | TGCCCTTCACTTTGTCGCCC |
| 2992 | SPAC19G12.11_UP | TGGCAGTCGGGGGCTAAAAA |
| 2993 | SPAC19G12.11_DN | GGGGGGAGATCGGCATGGAG |
| 2994 | SPAC19G12.12_UP | GCCAATCATACCGCAGACATG |
| 2995 | SPAC19G12.12_DN | CAGCCGCGCTCGGATCATAAA |
| 2996 | SPAC19G12.13c_UP | CGTGGTTCGTCGTGCTCGCC |
| 2997 | SPAC19G12.13c_DN | CTCGTTCGGTGCAGTCGCCG |
| 2998 | SPAC19G12.14_UP | TAAGGTCGAGACGCGGGCTG |
| 2999 | SPAC19G12.14_DN | GGTGCCGATCAGTGCCTGTT |
| 3000 | SPAC19G12.15c_UP | CCCTACTATGCCCGCCATTG |
| 3001 | SPAC19G12.15c_DN | TCGCAATCGGGAAATCGTCC |
| 3002 | SPAC19G12.16c_UP | ACCATCCCGCCTTCACAAAA |
| 3003 | SPAC19G12.16c_DN | CGTCGTTTTGCGCCGTAAGC |
| 3004 | SPAC1A6.04c_UP | AATCAGGTTCCCAGGGCGAC |
| 3005 | SPAC1A6.04c_DN | TGCCTGTCGGATGGTCACTC |
| 3006 | SPAC1A6.05c_UP | CCCGGTACCCCTGCAAATG |
| 3007 | SPAC1A6.05c_DN | ATTGTCCCGCCGTCCAACAA |
| 3008 | SPAC1A6.06c_UP | GTATGGATTGCGGTCGAGCC |
| 3009 | SPAC1A6.06c_DN | CTTTTTCGACCCCACCGCTC |
| 3010 | SPAC1A6.07_UP | GCTGAACAATAACCCCGGTCG |
| 3011 | SPAC1A6.07_DN | GGAGAAGGGATCGGAACCGC |
| 3012 | SPAC1A6.08c_UP | TAGCTCCATCCGCCACTGCA |
| 3013 | SPAC1A6.08c_DN | TGCAGCCACGATAGACCGCC |
| 3014 | SPAC1A6.09c_UP | GCATGGGCCGTAAGCTCGT |
| 3015 | SPAC1A6.09c_DN | ACGAAAGCGCCAGCAACAGG |
| 3016 | SPAC1B1.01_UP | CCACCAGCAGCAGTTCCCCG |
| 3017 | SPAC1B1.01_DN | CCCGCAAACTCACCCCCGT |
| 3018 | SPAC1B1.02c_UP | ACCCTAGGCCGTTAGCGTGGT |
| 3019 | SPAC1B1.02c_DN | CGTGATCGCCGACTAAGGCT |
| 3020 | SPAC1B1.03c_UP | CACACCAGCCGTCCAACCGT |
| 3021 | SPAC1B1.03c_DN | CTTCCGACCCGACAACCCTC |
| 3022 | SPAC1B1.04c_UP | CCGGTGAGGGACTGGCTGAG |
| 3023 | SPAC1B1.04c_DN | ATCCACGCGTCACCAAAGGC |
| 3024 | SPAC1B2.02c_UP | CCCTAAGACCCCACCGCTTT |
| 3025 | SPAC1B2.02c_DN | GCCGAAACCTCCACAACCAG |
| 3026 | SPAC1B2.04_UP | TGGAGGTGCCCGGGAAGGAG |
| 3027 | SPAC1B2.04_DN | TCCGATGAGCGGCGAACAAT |
| 3028 | SPAC1B3.01c_UP | TAATGGTGTTGCCCCGTGCG |
| 3029 | SPAC1B3.01c_DN | ATGCTCGTGCGCGGTTATTG |
| 3030 | SPAC1B3.02c_UP | AGGGGGTGTTGTCGGGATGT |
| 3031 | SPAC1B3.02c_DN | CACCACCTGGCGAACAACCG |
| 3032 | SPAC1B3.03c_UP | GGGGTTTGACGGGCGAAGT |
| 3033 | SPAC1B3.03c_DN | TTCCGCTTTGTCCGCTCCTG |
| 3034 | SPAC1B3.04c_UP | CCACCCCGTCGCTCATCCT |
| 3035 | SPAC1B3.04c_DN | GACGATCCGGAGTGGGCAAA |
| 3036 | SPAC1B3.05_UP | ACGGCGATAGCCATTTCCCC |
| 3037 | SPAC1B3.05_DN | TTCATCAAACTCTCGGCGCG |
| 3038 | SPAC1B3.06c_UP | TCGCGGGGGTGGGTCTTTTA |
| 3039 | SPAC1B3.06c_DN | GTCTTTGGTTCCCCCGCTCG |
| 3040 | SPAC1B3.07c_UP | TCAGCAAGCGCGCAACGTAC |
| 3041 | SPAC1B3.07c_DN | TGTCCTTCCCGGTGTGCCTC |
| 3042 | SPAC1B3.08_UP | GTTGCGGCCAGCGTATGAAA |
| 3043 | SPAC1B3.08_DN | GTTCTCACCCCGGCATTTGG |
| 3044 | SPAC1B3.09c_UP | CACGTGCTATCTCACCGGGA |
| 3045 | SPAC1B3.09c_DN | ACACGTACGAGCCACGAAGC |
| 3046 | SPAC1B3.10c_UP | CGGGTAGGAGCGGATGATGG |
| 3047 | SPAC1B3.10c_DN | ACACTACTCGCCGCGCCCAC |
| 3048 | SPAC1B3.11c_UP | AAAGGCCGCACCGCAAGAAA |
| 3049 | SPAC1B3.11c_DN | CCTGGCTCCTCTCCTGCTTG |
| 3050 | SPAC1B3.12c_UP | GCCCGAAAGCGCAGGATCAC |
| 3051 | SPAC1B3.12c_DN | CCATTGAATTTCCGGCGGGG |
| 3052 | SPAC1B3.15c_UP | TCCAACATCTCCCGCCCAGG |
| 3053 | SPAC1B3.15c_DN | GTGTATGGAGAAGGGCGGTA |
| 3054 | SPAC1B3.16c_UP | GGTGTAGAGGCGGGTGCGGA |
| 3055 | SPAC1B3.16c_DN | GGCGGGCAAGAAGAGGTTG |
| 3056 | SPAC1B3.17_UP | TCAGGGCGGGAGAATCGAAT |
| 3057 | SPAC1B3.17_DN | AATCCGCCCCGCAAACAGAC |
| 3058 | SPAC1B3.18c_UP | TCCGAGCGGTCCACAGAACG |
| 3059 | SPAC1B3.18c_DN | CGAACTCACCACGCTGCCGA |
| 3060 | SPAC1B3.20_UP | GGAAAAGCTCAGTGCCGGGG |

FIG.22

| Sequence number | Name | Base sequence | Sequence number | Name | Base sequence |
|---|---|---|---|---|---|
| 3061 | SPAC1B3.20_DN | CATCGCCTCCCACACCCTTG | 3163 | SPAC1F8.04c_DN | GGGGCGTTACTCCGAGCAGG |
| 3062 | SPAC1B9.02c_UP | AATGTCCCGCCCCCTAAAGC | 3164 | SPAC1F8.05_UP | TTGGACGGGGATTTACGGCG |
| 3063 | SPAC1B9.02c_DN | CGACGCCACAACTTCCACGA | 3165 | SPAC1F8.05_DN | GGTCAGAATGGGTGGCGGAC |
| 3064 | SPAC1D4.02c_UP | GTGTCTACCCCGCTGCCGGT | 3166 | SPAC1F8.06_UP | CGGACGGAGAGGCGGGTACA |
| 3065 | SPAC1D4.02c_DN | GAGCCGGTGTTCGGGGGTAT | 3167 | SPAC1F8.06_DN | TTCCAAGGCGCGGGTATCAA |
| 3066 | SPAC1D4.03c_UP | AATTCCGCTATGGCCCCGT | 3168 | SPAC1F8.07c_UP | CTGACCGCTCGCCCGGAATGT |
| 3067 | SPAC1D4.03c_DN | AGGGCCAGAGCGACGTAGCA | 3169 | SPAC1F8.07c_DN | TCCATTAGTCGTGCGTCGGG |
| 3068 | SPAC1D4.04_UP | CGAGGCGGACTTGGTGGTCT | 3170 | SPAC1F8.08_UP | CGTTGATCAGGCAGGGCAAG |
| 3069 | SPAC1D4.04_DN | CATACAAGCACGCGCCTCGA | 3171 | SPAC1F8.08_DN | CGCGCTTCACGTACGTCGTT |
| 3070 | SPAC1D4.05c_UP | CTTCCAGTCCGCATCACCCC | 3172 | SPAC20G4.01_UP | CGCGCGACCCCAATAAACCC |
| 3071 | SPAC1D4.05c_DN | TACGGATCGCGGGGAACAAA | 3173 | SPAC20G4.01_DN | CGTTTGGAAGGGGTGCGTCA |
| 3072 | SPAC1D4.06c_UP | GGGGCGAGGATTGCATGAGT | 3174 | SPAC20G4.02c_UP | CGAGTTGGGGAGCCCGTGTC |
| 3073 | SPAC1D4.06c_DN | ACATCAACTTGCCGTCGGGG | 3175 | SPAC20G4.02c_DN | CAGGTTCATGGCGCCGTCTC |
| 3074 | SPAC1D4.07c_UP | AGGTCGTGCGGGTATGGGGG | 3176 | SPAC20G4.03c_UP | TTATGCGACGGCGGACGAT |
| 3075 | SPAC1D4.07c_DN | AGTTGCGGCGGTTGATGAGC | 3177 | SPAC20G4.03c_DN | GCATTGATCGGGCAGACGGC |
| 3076 | SPAC1D4.08_UP | TGACAGGATTCGTAGGGCCG | 3178 | SPAC20G4.04c_UP | TAGGGGCGGAGGACGGTAT |
| 3077 | SPAC1D4.08_DN | AATAAGAGCGCGTCGCCACA | 3179 | SPAC20G4.04c_DN | AATCCCCGTCCCATTCCAGC |
| 3078 | SPAC1D4.09c_UP | AGCGGTTGTTTGGAGGTGGG | 3180 | SPAC20G4.05c_UP | GCACAACGGGGAAATGGAGG |
| 3079 | SPAC1D4.09c_DN | CCAAGAGCCCAGACCGAAG | 3181 | SPAC20G4.05c_DN | TCGATTCLTGTCCTCCCGGG |
| 3080 | SPAC1D4.11c_UP | CGCACCCTATTCCACTGCC | 3182 | SPAC20G4.06c_UP | CGCCGTCCGTCTTCGCCTTA |
| 3081 | SPAC1D4.11c_DN | AGCCGACCCAAACGAGCAGA | 3183 | SPAC20G4.06c_DN | TGACGGGCATTGTTGGGGAC |
| 3082 | SPAC1D4.12_UP | CTGGCAATAGCCCCGTCGG | 3184 | SPAC20G4.07c_UP | GCCGCGCTACACCCGTTATT |
| 3083 | SPAC1D4.12_DN | ACGTTGAAGGGGGTTGGACG | 3185 | SPAC20G4.07c_DN | CGCGGTGGGAGAAGTGGGTA |
| 3084 | SPAC1D4.13_UP | ATTCCGGCGTGACCCACCTG | 3186 | SPAC20G8.01_UP | GGGAACCCAGTAGCCCGAT |
| 3085 | SPAC1D4.13_DN | GACGGAGACGTGGGACGCG | 3187 | SPAC20G8.01_DN | GTCGGTTATGGGTGGGTCGC |
| 3086 | SPAC1F12.02c_UP | GCAGGAGGCATTTAGGCCGG | 3188 | SPAC20G8.03_UP | GGGTGTGACTGGCGGGAAA |
| 3087 | SPAC1F12.02c_DN | AGATGTGGCCCCGCTGTGAA | 3189 | SPAC20G8.03_DN | TGGAGCGTATGGAGGGCAGG |
| 3088 | SPAC1F12.03c_UP | GGCCTTAATCGAGCGGGGGA | 3190 | SPAC20G8.04c_UP | TCACCCAGCCGCAGTTACA |
| 3089 | SPAC1F12.03c_DN | TGGCAGCAGACACGGGAT | 3191 | SPAC20G8.04c_DN | CCGGAATGAACGTAGGCGCC |
| 3090 | SPAC1F12.04c_UP | GCGCTAAATCCCCGCTCCCC | 3192 | SPAC20G8.06_UP | AGCCCAACAGCCGACCAGTC |
| 3091 | SPAC1F12.04c_DN | GCTTCGCGGCCATGTACCTCC | 3193 | SPAC20G8.06_DN | GAGTTGGGAAGCACGACGCC |
| 3092 | SPAC1F12.05_UP | CCTGGGTTCGGGGTGCGTTC | 3194 | SPAC20G8.07c_UP | GGCCTGCTGAACGAACCGAT |
| 3093 | SPAC1F12.05_DN | TGGCCTTTGTCGCGTGGGTT | 3195 | SPAC20G8.07c_DN | TCGGGCGAACATGATCCAGC |
| 3094 | SPAC1F12.06c_UP | CCGGGAATACCCCCACAAAA | 3196 | SPAC20G8.08c_UP | ACCGGGTGTGGAGCTGCATG |
| 3095 | SPAC1F12.06c_DN | CTCGAAGCCGTCTTTCCCAC | 3197 | SPAC20G8.08c_DN | AGACGGTAGCGGGAAGGGGT |
| 3096 | SPAC1F12.C7_UP | AGCCTGCAAACATCTCCCCC | 3198 | SPAC20G8.09c_UP | GAGGAGACTGTGGTGGGGGC |
| 3097 | SPAC1F12.07_DN | ACGCGAGCTGGGACGAACAC | 3199 | SPAC20G8.09c_DN | ACGTTACGTACTACGCGGCT |
| 3098 | SPAC1F12.08_UP | ACCATCGATCCCCCGTTCC | 3200 | SPAC20H4.02_UP | CCTCGCGTCCGATTTGTGAG |
| 3099 | SPAC1F12.08_DN | TCAGATGTTGTCCGCGTCCG | 3201 | SPAC20H4.02_DN | CGCGTCAGCTACCCCGATA |
| 3100 | SPAC1F12.09_UP | CACGGGGTCAAATGGCGGTC | 3202 | SPAC20H4.03c_UP | TTCCGCGCAGTTTGGGTCTG |
| 3101 | SPAC1F12.09_DN | CTAGGGCAGGCGTTGGCATC | 3203 | SPAC20H4.03c_DN | ACAAGCGTTCCCGGACTGAG |
| 3102 | SPAC1F12.10c_UP | CGGAGTCGCATGACGAAGC | 3204 | SPAC20H4.04_UP | CCTCTCTTGGCCCCGTC7C |
| 3103 | SPAC1F12.10c_DN | AGACGCACTATCGGCGGAGG | 3205 | SPAC20H4.04_DN | ATTCGGCTTGTTGGCTCCCC |
| 3104 | SPAC1F3.01_UP | GCGGGCGAGAAAAACGTCA | 3206 | SPAC20H4.C5c_UP | CCGGGGGCTGAAGACACAATG |
| 3105 | SPAC1F3.01_DN | CCACCCCGCCTCAGACGTTA | 3207 | SPAC20H4.C5c_DN | CTTGTGGGGCGAACCGCTA |
| 3106 | SPAC1F3.02c_UP | GCTTGCGGGGATACGACGGG | 3208 | SPAC20H4.06c_UP | TAACTGCGCAACGGGAAGG |
| 3107 | SPAC1F3.02c_DN | TAGGGCAGTTTGGACGGCGG | 3209 | SPAC20H4.06c_DN | GCTGTTCTCGTCGTCGGCTG |
| 3108 | SPAC1F3.03_UP | CGCTATTGGCCGGGGTCTTT | 3210 | SPAC20H4.07_UP | TGACTGCAAGCGGCCCGATA |
| 3109 | SPAC1F3.03_DN | CGTGGGCGGAGGTTGAAGAC | 3211 | SPAC20H4.07_DN | AGCTTTGCGGCTACGGGCAG |
| 3110 | SPAC1F3.05_UP | CTCGCAGAAAGGGCCACGTT | 3212 | SPAC20H4.08_UP | ATTGGATTGCGGCCCTTGAG |
| 3111 | SPAC1F3.05_DN | CCCCCCAAAGATAGACGCCA | 3213 | SPAC20H4.08_DN | GCGCTCGGATATGGGTATCG |
| 3112 | SPAC1F3.06c_UP | CCTATAAAGCCGCGGTCCA | 3214 | SPAC20H4.09_UP | AGCCGGTGCCAAGGGTGAAGG |
| 3113 | SPAC1F3.06c_DN | TACACGTCGCCTTGCCCCCT | 3215 | SPAC20H4.09_DN | AACTGGGCGTAGGACAGGGC |
| 3114 | SPAC1F3.07c_UP | GCATGGCCGTGGGTTTTGAA | 3216 | SPAC20H4.10_UP | CACCCCGCCCTGTAATCGCT |
| 3115 | SPAC1F3.07c_DN | TGGCCGCGTGCCGTCTGGTAC | 3217 | SPAC20H4.10_DN | CAGAAACCGCCCAGCAAGCG |
| 3116 | SPAC1F3.08c_UP | CGGGGGTTATCGGGACTTGA | 3218 | SPAC20H4.11c_UP | GGGTCCCGCAAACCCCATTG |
| 3117 | SPAC1F3.08c_DN | CAAACGGTCGCCCAACAATG | 3219 | SPAC20H4.11c_DN | CCCAGCCCTGCATCACACAC |
| 3118 | SPAC1F3.09_UP | CCGCACCAGGACAAACCAGA | 3220 | SPAC212.01c_UP | TGCCCGTGTAACTCTCCCCG |
| 3119 | SPAC1F3.09_DN | CCAGGGGGCAAGGTACGTA | 3221 | SPAC212.01c_DN | TCCCTATTCCCCGTGCCCTG |
| 3120 | SPAC1F3.10c_UP | GAGGGCGGGAGCCGAACAG | 3222 | SPAC212.02_UP | GCAGAACCCTCCCGCCAGTA |
| 3121 | SPAC1F3.10c_DN | GTTGGGTGGGGTTGTCTGGG | 3223 | SPAC212.02_DN | CCGTCCGTCCATCTTCTGCCC |
| 3122 | SPAC1F5.02_UP | GCCCCTTCCAAGTACCCGCT | 3224 | SPAC212.03_UP | ACATTAACCCCGGACCCGC |
| 3123 | SPAC1F5.02_DN | TCCACACATTACCCTCGGCG | 3225 | SPAC212.03_DN | AAGTCGCCCGAGAGTTAGGC |
| 3124 | SPAC1F5.03c_UP | TTAGGGGTGGAGCGGAGCAT | 3226 | SPAC212.04c_UP | ACGGGATTCGGTCTGTCGTT |
| 3125 | SPAC1F5.03c_DN | GTGGCTGCGGGGTCGGATAC | 3227 | SPAC212.04c_DN | CGTTTGGTTGGGTTGCGTCG |
| 3126 | SPAC1F5.04c_UP | TGTAGGGTATGCTGGCGGGG | 3228 | SPAC212.08c_UP | ACAGCGTCCTCCCAGCCGAG |
| 3127 | SPAC1F5.04c_DN | CTGCCGACCCAACCCTCTCA | 3229 | SPAC212.08c_DN | AGGAAAGCAAAACCCCCGA |
| 3128 | SPAC1F5.05c_UP | GCAGGGTTTGATAGGGCGGC | 3230 | SPAC212.11_UP | TGCTTTTAGGTCGTGGCGGG |
| 3129 | SPAC1F5.05c_DN | AGTGCGGAACTCGATTGTGA | 3231 | SPAC212.11_DN | GCGGTTGGCGGGTGTGTAGG |
| 3130 | SPAC1F5.07c_UP | GCGCCGTGTGTATAGCCCAA | 3232 | SPAC21E11.03c_UP | ACGGCAGGCGGCTCTAACAC |
| 3131 | SPAC1F5.07c_DN | TTGTGGGGCGGCTAGTGCTT | 3233 | SPAC21E11.03c_DN | CGCAGTTTGCATGAACGCCG |
| 3132 | SPAC1F5.08c_UP | GCGGAGGCATTGAGGCGAGTC | 3234 | SPAC21E11.04_UP | GGACGTTGATCGGGGCAGA |
| 3133 | SPAC1F5.08c_DN | TGATTGGGGGAGCCTGTGTG | 3235 | SPAC21E11.04_DN | GCGGAGCCGATATGGGGAACA |
| 3134 | SPAC1F5.09c_UP | AGGTGGGGCAGGTAAGCGG | 3236 | SPAC21E11.05c_UP | GTGAGGGACCGTATGGGAGA |
| 3135 | SPAC1F5.09c_DN | AGTGAGGGGCTGGCGAAGG | 3237 | SPAC21E11.05c_DN | CGGGGGGTCTGCCTTGTAT |
| 3136 | SPAC1F5.10_UP | GGGTTGTGGGGGTGGGTGC | 3238 | SPAC21E11.06_UP | CGCCCCTCGTCCTCTGCCTA |
| 3137 | SPAC1F5.10_DN | GGAGGTTGAGGGCGGGGGTA | 3239 | SPAC21E11.06_DN | CATTAACGTCTGGCCCGCC |
| 3138 | SPAC1F5.11c_UP | TGGGAGGTCAAGAGCGGCAA | 3240 | SPAC21E11.07_UP | CCTGTAGCGCCGGGTGTTCG |
| 3139 | SPAC1F5.11c_DN | CGCCGGGTGCTACCTCAGT | 3241 | SPAC21E11.07_DN | TCCCTGGCAGCTCTGACGTA |
| 3140 | SPAC1F7.02c_UP | GAACTCATGAGGGAGGGCGG | 3242 | SPAC222.05c_UP | TGACCGCCACCTCGACGTTG |
| 3141 | SPAC1F7.02c_DN | GCCCCGCCGATCGAGTCTCT | 3243 | SPAC222.05c_DN | CGTATGAGCCCGACGTCCCC |
| 3142 | SPAC1F7.03_UP | AGGTGCGACGGGAATTGTGGC | 3244 | SPAC222.06_UP | CCGTCCATCCGCCTTAFCCA |
| 3143 | SPAC1F7.03_DN | TAGCGCCTCCGGTTCCTTGC | 3245 | SPAC222.06_DN | ATTCGTCGGGTGTCGTCGGG |
| 3144 | SPAC1F7.06_UP | TGCCACCAACGAAGCGAATC | 3246 | SPAC222.07c_UP | TCGCGTCGTTCCGTTTGGTA |
| 3145 | SPAC1F7.06_DN | CCGTAATTCCGGACCCCTAA | 3247 | SPAC222.07c_DN | CTGCCCGTATTTTCTCCCG |
| 3146 | SPAC1F7.07c_UP | AGGCTATTGTTGGGCGGGGG | 3248 | SPAC222.08c_UP | ATCCGTGTTAGCCCCCTGCCC |
| 3147 | SPAC1F7.07c_DN | GGGAAAATGGGTTAGGGGCG | 3249 | SPAC222.08c_DN | AATCTTCCFCTTGCGCGGCT |
| 3148 | SPAC1F7.08_UP | ATACCCAACTCCCCCCCGAC | 3250 | SPAC222.09_UP | TGCCCACCTCGTTTCACCACG |
| 3149 | SPAC1F7.08_DN | GCGGCAAGTTAGGAGCGGAA | 3251 | SPAC222.09_DN | AGCGGTTCGGGTGGAGTGAT |
| 3150 | SPAC1F7.09c_UP | AAAGCCCGCAPACCCACCACG | 3252 | SPAC222.10c_UP | TCAACTCTGCGGGCTCCTCG |
| 3151 | SPAC1F7.09c_DN | CCAGCAACACAGCAGCCAA | 3253 | SPAC222.10c_DN | TGCATGACCGCCCAGTTTGG |
| 3152 | SPAC1F7.10_UP | TGGGGAGCCAGAGAAGCGGC | 3254 | SPAC222.12_UP | AACCACCCGAGCACCAGCCT |
| 3153 | SPAC1F7.10_DN | ACCACGTTACCTCCCGCCCC | 3255 | SPAC222.12c_DN | TTACGGGTGGGCGTGTATGC |
| 3154 | SPAC1F7.11c_UP | TGAGCCTTCCGACAATTGCG | 3256 | SPAC222.13c_UP | TGATTGGAGCGCGTCTGGGA |
| 3155 | SPAC1F7.11c_DN | CCCTGCGCCACACATCAAGC | 3257 | SPAC222.13c_DN | CGGCTTTCGCTTCTGGGGTT |
| 3156 | SPAC1F8.01_UP | CCAGCAAGCCTCAAAACGC | 3258 | SPAC222.14c_UP | GACCCACCCGCATCACAACC |
| 3157 | SPAC1F8.01_DN | TGCTCGCTTCGTTCTGCCTG | 3259 | SPAC222.14c_DN | ACAGTCCTGCCGTCTGCGAA |
| 3158 | SPAC1F8.02c_UP | AGATCGCCGCAAGCCAAGGA | 3260 | SPAC227.03c_UP | GGGGCAAGACCAGGATGGGG |
| 3159 | SPAC1F8.02c_DN | TGTGTTCACTCCGAGGCTGC | 3261 | SPAC227.03c_DN | CTCTGGGGTTGGGCCTGGTA |
| 3160 | SPAC1F8.03c_UP | GAATGGGGGTGGGCTTTCAA | 3262 | SPAC227.04_UP | ACCGTCATCACLAACACCGC |
| 3161 | SPAC1F8.03c_DN | GTCGTGGGGGAGATAGGCG | 3263 | SPAC227.04_DN | TCGAGGGCGCGCTTAACACT |
| 3162 | SPAC1F8.04c_UP | ACATGCCCATCGCGGACCGA | 3264 | SPAC227.05_UP | ATTATGGCGGAGCGGGGGT |

FIG.23

| Sequence number | Name | Base sequence |
|---|---|---|
| 3265 | SPAC227.05_DN | CGAACGAAGCATTCCAGGGC |
| 3266 | SPAC227.06_UP | CCGTTACCGCTTTGGCCTGG |
| 3267 | SPAC227.06_DN | GGGCGAGTCGCGGTGCTTGT |
| 3268 | SPAC227.07c_UP | CCCTGCCCGTCACCTCATCG |
| 3269 | SPAC227.07c_DN | GGCAGGGGCTTACGGTCGGT |
| 3270 | SPAC227.08c_UP | TCGCCCCGTACCCTACCACG |
| 3271 | SPAC227.08c_DN | GATTAAAGCGACGCGAGGCC |
| 3272 | SPAC227.09_UP | TAGGGGCGGGGCTTGTGTCC |
| 3273 | SPAC227.09_DN | CAGAAGGATCCGGGCGCAAC |
| 3274 | SPAC227.10_UP | AACACATGTGGCCAACCCCG |
| 3275 | SPAC227.10_DN | CCCGAACACCGCCATAGATG |
| 3276 | SPAC227.11c_UP | ATTTCCCGAGCACCCCTTCC |
| 3277 | SPAC227.11c_DN | TCCTCCTAGCCCGCAACTGG |
| 3278 | SPAC227.12_UP | TTTGTGGCGGAACTATGCG |
| 3279 | SPAC227.12_DN | TCTCGGTGCGGGGGTGTTTC |
| 3280 | SPAC227.13c_UP | CAGGGGCTGTCATCGTCGGG |
| 3281 | SPAC227.13c_DN | TGCTTGTGGGACCCTGCGCT |
| 3282 | SPAC227.15_UP | GCGGCGAATGAAGTGAGGCT |
| 3283 | SPAC227.15_DN | GGGGACTGGTGATGGCGATG |
| 3284 | SPAC227.17c_UP | CGGCGTCGGTGAGGAAGGAT |
| 3285 | SPAC227.17c_DN | AGTCGTCTAGACCGTCGGGT |
| 3286 | SPAC22A12.02c_UP | CGTTGATCCGCCGCTTATGC |
| 3287 | SPAC22A12.02c_DN | CGCTGCTCCTGCCTTCGATG |
| 3288 | SPAC22A12.03c_UP | CTTTTGGCAGGGGACCGGAG |
| 3289 | SPAC22A12.03c_DN | ATGCTTTGGAGGAACGGCA |
| 3290 | SPAC22A12.04c_UP | CCAAFCGGCGTCAATGCTTG |
| 3291 | SPAC22A12.04c_DN | AGGGGCTGGGACGGGGGACA |
| 3292 | SPAC22A12.05_UP | CGAGAACCAAGCGGGTGGGA |
| 3293 | SPAC22A12.05_DN | GGCGGCTGATATGTCGGGAC |
| 3294 | SPAC22A12.06c_UP | CCCGATGTAGCGCCGAGTTC |
| 3295 | SPAC22A12.06c_DN | AGGGCTGCGGGGAAATATCGT |
| 3296 | SPAC22A12.07c_UP | TGTAGACAACGCCGAGCCC |
| 3297 | SPAC22A12.07c_DN | TTTGGGCGAAAGCCACTTG |
| 3298 | SPAC22A12.09c_UP | CGTGCCCCACTCGTCTCCTG |
| 3299 | SPAC22A12.09c_DN | TGTTCCGTTTCGGTTGGCA |
| 3300 | SPAC22A12.10_UP | AGGCCCTCCAGCGAATTAGCG |
| 3301 | SPAC22A12.10_DN | CTCCCCAGCTGTCGTCCCCG |
| 3302 | SPAC22A12.11_UP | TTCCCCCTATTCGCACACGG |
| 3303 | SPAC22A12.11_DN | TTCGGAGTTGGATGGCCGGT |
| 3304 | SPAC22A12.12c_UP | ATCGGCAAGGTCGGTCAGGC |
| 3305 | SPAC22A12.12c_DN | ACACGCAGCGCCCGGTAACT |
| 3306 | SPAC22A12.13_UP | GCCCCTAAGCCTCCATCCCG |
| 3307 | SPAC22A12.13_DN | TAACCCAGGCTCTCGTCCCA |
| 3308 | SPAC22A12.14c_UP | GGGCGTGGTCGGGATGGTAT |
| 3309 | SPAC22A12.14c_DN | TTAGTTTGGGTTGCGGGGC |
| 3310 | SPAC22A12.15c_UP | CAACTAGCGGGGTGGCTCGA |
| 3311 | SPAC22A12.15c_DN | ACTCGCGGGTACTCACGCTT |
| 3312 | SPAC22A12.16_UP | TGCAAATGAGCCCCACGTCG |
| 3313 | SPAC22A12.16_DN | TGCGTTGATGGGGAGGTTGA |
| 3314 | SPAC22A12.17c_UP | TCACCGTCAGTCCCCGCCAC |
| 3315 | SPAC22A12.17c_DN | GGGGTGTGGCGGACGAAATT |
| 3316 | SPAC22E12.01_UP | ACGGGTCTGGTCTTTGCGG |
| 3317 | SPAC22E12.01_DN | CGCTAACATGGGCTCGGGAT |
| 3318 | SPAC22E12.02_UP | AAGCCAAGGAGGGGGTGCCA |
| 3319 | SPAC22E12.02_DN | GCCCATCGATCACCCCTCCAC |
| 3320 | SPAC22E12.03c_UP | CGAGGGGACATGTGGGGGTA |
| 3321 | SPAC22E12.03c_DN | GGACGAGTAGGGGGAGCGCG |
| 3322 | SPAC22E12.04_UP | GTCATCTTCCGTGGGCCCTC |
| 3323 | SPAC22E12.04_DN | ACCGACCCGCCCCCGTTAAT |
| 3324 | SPAC22E12.05c_UP | GGAACCGCAGAACACGTGAC |
| 3325 | SPAC22E12.05c_DN | TGGAGGGCTAGGAGGCGTGG |
| 3326 | SPAC22E12.06c_UP | CCGTTGCCACCGATTTGGGA |
| 3327 | SPAC22E12.06c_DN | GGCTGAAGTGGATGGCGCAA |
| 3328 | SPAC22E12.07_UP | AGCACGCTATTACCCGCCGA |
| 3329 | SPAC22E12.07_DN | TATCCTAGCACGCGGGGGTT |
| 3330 | SPAC22E12.09c_UP | GCAAGCCCGCCAATCAGTCC |
| 3331 | SPAC22E12.09c_DN | TCGTCGCCGTGCCTCATTTC |
| 3332 | SPAC22E12.10c_UP | CCCGCGAAGCTGTTCCTAACC |
| 3333 | SPAC22E12.10c_DN | CATTCACTACCGCCCCCAGG |
| 3334 | SPAC22E12.11c_UP | GAGCGGCCAACGTGCAAAC |
| 3335 | SPAC22E12.11c_DN | GGACGGTGGGATCTTGCGAT |
| 3336 | SPAC22E12.13c_UP | TGCAATACCGGCCGAAAGGA |
| 3337 | SPAC22E12.13c_DN | CCCGGGGTTGCGAAAGTTGA |
| 3338 | SPAC22E12.14c_UP | CCCGAACTGACAAAGGGCCG |
| 3339 | SPAC22E12.14c_DN | GTACTAGGCCCCCCGTTGCC |
| 3340 | SPAC22E12.16c_UP | AACGCGGAAATTTGGGGCTC |
| 3341 | SPAC22E12.16c_DN | TGTGTGGGGTATCCGAGGCG |
| 3342 | SPAC22E12.17c_UP | TCACGCCGGTAAGCGACAGT |
| 3343 | SPAC22E12.17c_DN | ACGGCTATACCCCCATCGCC |
| 3344 | SPAC22E12.18_UP | TGCGTCCCCTTCAGCTCGTC |
| 3345 | SPAC22E12.18_DN | GTCCAACAGGGCCGAAGCAT |
| 3346 | SPAC22F3.02_UP | TTACGTAGTCCATGCCGGGG |
| 3347 | SPAC22F3.02_DN | TCCACATTCGCAAAGCCACG |
| 3348 | SPAC22F3.03c_UP | AAGAGCGCAGAGCGAGCCAG |
| 3349 | SPAC22F3.03c_DN | TGCCGCGTAAATTCCCATG |
| 3350 | SPAC22F3.04_UP | CAGGCACGAAACCGCAAGGA |
| 3351 | SPAC22F3.04_DN | ACGAAAAGCCCGGCATCGTCA |
| 3352 | SPAC22F3.06c_UP | AGGACGCACCAACCGACGAT |
| 3353 | SPAC22F3.06c_DN | TAGAACCCATCGCAAGCGCA |
| 3354 | SPAC22F3.07c_UP | GCGATGTTTGAGATGGGCGT |
| 3355 | SPAC22F3.07c_DN | GAGAGAGCCGACTGCGGGTGG |
| 3356 | SPAC22F3.08c_UP | CGGCTTCCAGCAAACTCCCA |
| 3357 | SPAC22F3.08c_DN | AAACCTAGGGGGAATGCGGG |
| 3358 | SPAC22F3.09_UP | TTGCGCCTTGACCTACCCGG |
| 3359 | SPAC22F3.09c_DN | TCCTTGGTACGGGGTGGCTC |
| 3360 | SPAC22F3.10c_UP | TGGCAACGCGGCGGATTGTAG |
| 3361 | SPAC22F3.10c_DN | ACACTACCGCACGCAACCC |
| 3362 | SPAC22F3.11c_UP | GCGTGATCAAGGAGGCGGTG |
| 3363 | SPAC22F3.11c_DN | GCCGTGAAGGATTGGGAGGT |
| 3364 | SPAC22F3.12c_UP | GTGGTGGGGGAGATGAGGGG |
| 3365 | SPAC22F3.12c_DN | CCGTCAACAATCACGCAGCA |
| 3366 | SPAC22F3.13_UP | TCGTTCGCCCCCCATCCTAG |
| 3367 | SPAC22F3.13_DN | ACGCCTGCCATTCCCCATTT |
| 3368 | SPAC22F8.02c_UP | CCCGCAAGCAACCAGACACG |
| 3369 | SPAC22F8.02c_DN | ACACACCCACTCCGCAGCAA |
| 3370 | SPAC22F8.03c_UP | CATCCCCGATCAGTTTGGC |
| 3371 | SPAC22F8.03c_DN | ATTCCGACCCCGAGCCGTTA |
| 3372 | SPAC22F8.04_UP | CAAACCGCGGAGACAGGAA |
| 3373 | SPAC22F8.04_DN | TGGGCGGGTACATGGGAGAT |
| 3374 | SPAC22F8.05_UP | TGGAGCGAGCGGAGACGGAG |
| 3375 | SPAC22F8.05_DN | CCGCCCACCGTAAAGCAATC |
| 3376 | SPAC22F8.07c_UP | GCAAGCCAGCCACATCACCA |
| 3377 | SPAC22F8.07c_DN | TCCGTGCTACACCTATGGCG |
| 3378 | SPAC22F8.09_UP | CAGGCGAGGGACGTTGGGGT |
| 3379 | SPAC22F9.09_DN | TCGGTGCGGAGGGCTTTGAG |
| 3380 | SPAC22F9.11_UP | AAGTAAGGCTCCGTCGGGCA |
| 3381 | SPAC22F8.11_DN | CGCGTGGATGGGGTCAAAAG |
| 3382 | SPAC22G7.01c_UP | AGGGATCGGGTGCTACGGCT |
| 3383 | SPAC22G7.01c_DN | GGGCCGTGGTCGTGAGTGTG |
| 3384 | SPAC22G7.02_UP | CACCGGGTCCGTTCGAATCT |
| 3385 | SPAC22G7.02_DN | TAGGAGCCCGGTCACTGCTA |
| 3386 | SPAC22G7.03_UP | CAGGCAAGGCGGGACGATTA |
| 3387 | SPAC22G7.03_DN | GTGTCCCCGACGATAAGACG |
| 3388 | SPAC22G7.04_UP | TGAAATACCGGCAGCCACGC |
| 3389 | SPAC22G7.04_DN | TGTGCGGCTCCCTGTGGCTGG |
| 3390 | SPAC22G7.05_UP | TTTCTTCTTTGGGCGGGCA |
| 3391 | SPAC22G7.05_DN | GGGCTTCGGGTGCTCGTTTA |
| 3392 | SPAC22G7.06c_UP | ACGCGCGATGCCAGATATG |
| 3393 | SPAC22G7.06c_DN | GCAATGGGCACGGGAACAAA |
| 3394 | SPAC22G7.07c_UP | TCCAATGCAGTCCCCGTTT |
| 3395 | SPAC22G7.07c_DN | GATGGAATGCGGGGAATGA |
| 3396 | SPAC22G7.08_UP | ACGCCCAAGGTCAAAGGCCA |
| 3397 | SPAC22G7.08_DN | CGTGCAAGCCAGGTCCAAAA |
| 3398 | SPAC22G7.09c_UP | ACGTGAGCGTACGTGCGAAT |
| 3399 | SPAC22G7.09c_DN | CCTAGCGCATATAGCCGCA |
| 3400 | SPAC22G7.10_UP | TTGACGGCCGGCAGGTATTT |
| 3401 | SPAC22G7.10_DN | TACCACCAGCGCGCACACCT |
| 3402 | SPAC22H10.03c_UP | TGAGCGCGAAGTGTGGGAGT |
| 3403 | SPAC22H10.03c_DN | TCCCCCCTACCGACCGCCTC |
| 3404 | SPAC22H10.04_UP | AGCGCCGTGTGATTTGGACA |
| 3405 | SPAC22H10.04_DN | CCCACTGCATTAGCGCACC |
| 3406 | SPAC22H10.05c_UP | GCGCGTGGGAATAAAAGGCG |
| 3407 | SPAC22H10.05c_DN | CAGGGATCGGCATAACGGCG |
| 3408 | SPAC22H10.06c_UP | CGGGGGGGCTGTCCTAATTT |
| 3409 | SPAC22H10.06c_DN | AAATTAATGGGGGTCGTGCG |
| 3410 | SPAC22H10.07_UP | CCTCCTGGCCGCTGAATCCA |
| 3411 | SPAC22H10.07_DN | TCCCGCCCGGTAATCAGTGG |
| 3412 | SPAC22H10.08_UP | ACAACAAAATGCACCACCCG |
| 3413 | SPAC22H10.08_DN | CGAACGCGGCACCAGAATAG |
| 3414 | SPAC22H10.09_UP | CGCATCCCGCTTCCCCAGAG |
| 3415 | SPAC22H10.09_DN | AAGCCGCCCTACAAACCCCS |
| 3416 | SPAC22H10.10_UP | CTGCCCCGACCGCCCGTCTTA |
| 3417 | SPAC22H10.10_DN | CGAGAAACCTGCCAACCCGC |
| 3418 | SPAC22H10.11c_UP | TACGGCTGGCCGGTTGAGG |
| 3419 | SPAC22H10.11c_DN | GGTTTGGATGGGCCGGTCTG |
| 3420 | SPAC22H10.13_UP | GCGCATGGTTGGGTTGGGAC |
| 3421 | SPAC22H10.13_DN | CGGACCCTTCTTACCCCCGA |
| 3422 | SPAC22H12.02_UP | TAGGTTGGCGCAAAGGGCTC |
| 3423 | SPAC22H12.02_DN | ATGCGTTCTCCAATGCGGTG |
| 3424 | SPAC22H12.03_UP | GCTGACGCGGATTGGACTGG |
| 3425 | SPAC22H12.03_DN | CAGGTTGTCGCGCGGGTCAG |
| 3426 | SPAC22H12.04c_UP | TCTGTGCTACCGGGGGGAA |
| 3427 | SPAC22H12.04c_DN | ACCCTAACAAACGGCCCGG |
| 3428 | SPAC22H12.05c_UP | TGCCACACCCATCTCGCGT |
| 3429 | SPAC22H12.05c_DN | CTTCACCCGCCCGCATCAAA |
| 3430 | SPAC23A1.02c_UP | TTCTCGCTCCTACGCACCAG |
| 3431 | SPAC23A1.02c_DN | CAGCAATGAGCAAGCCCCGT |
| 3432 | SPAC23A1.04c_UP | GAACGCAGGGAGAATGGGCA |
| 3433 | SPAC23A1.04c_DN | CGTAACTAGACGTGCCGGCG |
| 3434 | SPAC23A1.06c_UP | ATTCAGGTGCGGCCCAAGCA |
| 3435 | SPAC23A1.06c_DN | TCTCACCGCGCGGAACATCT |
| 3436 | SPAC23A1.07_UP | TTGCACTCCAGCACCATCCC |
| 3437 | SPAC23A1.07_DN | GCTTGACCGCGATTTCCCG |
| 3438 | SPAC23A1.08c_UP | ACGGCGCTGTTCGTACCATG |
| 3439 | SPAC23A1.08c_DN | GCCAAACGCATCAGGCATCC |
| 3440 | SPAC23A1.09_UP | GTGCGGCTATACCTGGGATG |
| 3441 | SPAC23A1.09_DN | TAGTCGCCACGGTGAGAGGC |
| 3442 | SPAC23A1.12c_UP | TCCAGTACTTCGCTTGCTAC |
| 3443 | SPAC23A1.12c_DN | TGCCGTGCCCCAGATAGTCC |
| 3444 | SPAC23A1.14c_UP | CATGCTCTTGTCGTGGGCCG |
| 3445 | SPAC23A1.14c_DN | TGTTGGCCCTCCCCTGTCAT |
| 3446 | SPAC23A1.15c_UP | CCCCCCCTAGAAIAACCCCG |
| 3447 | SPAC23A1.15c_DN | ACCTTGGTTACGCGGTCGCT |
| 3448 | SPAC23A1.16c_UP | TAGCACATGCGGGGGGTTG |
| 3449 | SPAC23A1.16c_DN | TACCCGGAACGCGACTGCAC |
| 3450 | SPAC23A1.17_UP | TGGTTGGGCGTTCGGGAGTA |
| 3451 | SPAC23A1.17_DN | GCCTGCTTATTCGGGCCAAG |
| 3452 | SPAC23C11.01c_UP | GGGCCTCCGAAAATCTGCTG |
| 3453 | SPAC23C11.01c_DN | CGGGCAACCAGCAGAAGCAG |
| 3454 | SPAC23C11.02c_UP | CCCAATCAGTTTCGTGCCA |
| 3455 | SPAC23C11.02c_DN | CAGGCCGTAGCCCAACCATG |
| 3456 | SPAC23C11.03_UP | CGGGGAACAGCTGAGTTGGA |
| 3457 | SPAC23C11.03_DN | CTGATTCGATACCGGCGGC |
| 3458 | SPAC23C11.04c_UP | AGTGACACGGATGAGGGCGG |
| 3459 | SPAC23C11.04c_DN | GGGACCCACCCATTGTCTG |
| 3460 | SPAC23C11.05_UP | CCCTCCCGCACAAGCAAGGT |
| 3461 | SPAC23C11.05_DN | TCCTCCTTTCGCTTCCCACG |
| 3462 | SPAC23C11.06c_UP | AAATCCCCCACGCCCAGAAC |
| 3463 | SPAC23C11.06c_DN | TGCGTTTGATGACCCCCGA |
| 3464 | SPAC23C11.07_UP | GGTATGGCTTTTCCCGGCGT |
| 3465 | SPAC23C11.07_DN | TTCCATGCTCTTCCGCGCTCC |
| 3466 | SPAC23C11.10_UP | AATGAAACGGGAAGCTGCGG |
| 3467 | SPAC23C11.10_DN | CACGCGGGATGAATAAGGC |
| 3468 | SPAC23C11.11_UP | GCAGGTTGCTACAGAGTGCG |

| Sequence number | Name | Base sequence |
|---|---|---|
| 3673 | SPAC25B8.08_DN | CCCCCAGCGGACTCAAAGA |
| 3674 | SPAC25B8.09_UP | CAATCGTATCCGCCTTCCGC |
| 3675 | SPAC25B8.09_DN | ACCATTGCCACCGCCGTTCCG |
| 3676 | SPAC25B8.10_UP | TGCTTCGTACGCGCTAGCCT |
| 3677 | SPAC25B8.10_DN | GAAGAACCGGTCGTCGCTTG |
| 3678 | SPAC25B8.11_UP | AGGCTCACCCGAACGCGAAT |
| 3679 | SPAC25B8.11_DN | ATTCTACGTAGCGGGGCCGG |
| 3680 | SPAC25B8.12c_UP | CCGCAGCAACAACAGCCATC |
| 3681 | SPAC25B8.12c_DN | CCCCGAAGGCAGCAGGATGA |
| 3682 | SPAC25B8.13c_UP | GTGCCATACACAAGACGGGC |
| 3683 | SPAC25B8.13c_DN | AAGCTAGTGACCGGCCCCCA |
| 3684 | SPAC25B8.14_UP | TCGATGGTCACGCCACTTGT |
| 3685 | SPAC25B8.14_DN | GTAGGTTTCGGCTCCGGGAA |
| 3686 | SPAC25B8.15c_UP | CTGAGAAGTATGCCGCGGGA |
| 3687 | SPAC25B8.15c_DN | ACCGTTTCGCGCATTCTTGC |
| 3688 | SPAC25B8.16_UP | TCAATAAGGTCCCGGCCCCC |
| 3689 | SPAC25B8.16_DN | CCCCCTCCTGCCGAACAATC |
| 3690 | SPAC25B8.17_UP | AGGCAGCGACACATCACCGG |
| 3691 | SPAC25B8.17_DN | TTTTCGTCTCTGGGGGGTGC |
| 3692 | SPAC25B8.18_UP | TATTGACTGCCCGCTGCCGG |
| 3693 | SPAC25B8.18_DN | CCCCGCATCCAGGCCACATA |
| 3694 | SPAC25G10.02_UP | CCATGTTCCACCCCCCTGCG |
| 3695 | SPAC25G10.02_DN | CGATGGGTTGGACGAGCAGT |
| 3696 | SPAC25G10.03_UP | GACCCGGAAAGCGTCTGTGC |
| 3697 | SPAC25G10.03_DN | CGGGTCGCTCTTCAGGTGCA |
| 3698 | SPAC25G10.04c_UP | ACAACGACCTGACCCACGCA |
| 3699 | SPAC25G10.04c_DN | AACACAGGCACCACGGTAGG |
| 3700 | SPAC25G10.05c_UP | GCGTGAGGATGTGGAGCGGA |
| 3701 | SPAC25G10.05c_DN | TCCCGGCGAGCAAACACACA |
| 3702 | SPAC25G10.07c_UP | CTGCAACCACACAAACGCTG |
| 3703 | SPAC25G10.07c_DN | ACAAGGGGTAAATCGGGGGG |
| 3704 | SPAC25G10.08_UP | GCTGACCCGTTCTTTGCCCG |
| 3705 | SPAC25G10.08_DN | CCTCAAGCGCGTGTCCCATA |
| 3706 | SPAC25H1.02_UP | CGTGGGCGGCAGGTACGTTT |
| 3707 | SPAC25H1.02_DN | GCCGCCGCAAATCAGCTCTA |
| 3708 | SPAC25H1.03_UP | CGGGCCGGCTAAGATGGTCAA |
| 3709 | SPAC25H1.03_DN | CACGGCCTGGCCATTCGTTGA |
| 3710 | SPAC25H1.04_UP | CGAACCTGCGGCCCACAATCA |
| 3711 | SPAC25H1.04_DN | GCCCCAAAATGCATAGCCCA |
| 3712 | SPAC25H1.05_UP | CATGCACGTGGCGACTCATC |
| 3713 | SPAC25H1.05_DN | AAATTCCCACCGTATCGCCG |
| 3714 | SPAC25H1.06_UP | TGCGATGACAGGTTGGGGAG |
| 3715 | SPAC25H1.06_DN | AGCATGTACCGCGTTTGGGG |
| 3716 | SPAC25H1.07_UP | TGCTCGTGGGCTGGACTGGA |
| 3717 | SPAC25H1.07_DN | TAACCCAGCGCGCCCTAACCT |
| 3718 | SPAC25H1.08c_UP | CGGGCTCGGACTGCAGGAAG |
| 3719 | SPAC25H1.08c_DN | CGGTGCCCCAGTAAAAAGGC |
| 3720 | SPAC25H1.09_UP | TTCTTTCCCGCCCCACCGAT |
| 3721 | SPAC25H1.09_DN | TCCTTCGCCACCACCACCAA |
| 3722 | SPAC26A3.01_UP | CATCAGTCGAACCGCAGGCGG |
| 3723 | SPAC26A3.01_DN | GACAGGGCACCGATGACACG |
| 3724 | SPAC26A3.02_UP | CACCCAACCAACATCGCAA |
| 3725 | SPAC26A3.02_DN | AGGGCCGGACAGGGTGAGT |
| 3726 | SPAC26A3.03c_UP | CGTAGGGTAAGGATGCCGCC |
| 3727 | SPAC26A3.03c_DN | TTACCCCGCGTGTTGTGCA |
| 3728 | SPAC26A3.04_UP | GCAAAACTCCGGCTGCAGCT |
| 3729 | SPAC26A3.04_DN | GCGACAAAAACCGCCTCGGA |
| 3730 | SPAC26A3.05_UP | GAACCCACCCCCAGCACAAG |
| 3731 | SPAC26A3.05_DN | TCAACCCGACACACTCCCCG |
| 3732 | SPAC26A3.06_UP | CGGGGGGGTTAACTGAGGTG |
| 3733 | SPAC26A3.06_DN | TGCCCGATAACCGCTCCCGT |
| 3734 | SPAC26A3.08_UP | CCACACCTGCCGATTCCTCG |
| 3735 | SPAC26A3.08_DN | CATACACCCGACTTGCCCGA |
| 3736 | SPAC26A3.09c_UP | CATCCGTGCCCGTTGGTTGCT |
| 3737 | SPAC26A3.09c_DN | CGCCGACCGATACACAACGC |
| 3738 | SPAC26A3.10_UP | ACCGAGGGCTTGGGGACACC |
| 3739 | SPAC26A3.10_DN | CCGACCCCACGATGGAAAAT |
| 3740 | SPAC26A3.11_UP | ATTCTTTGGCTGCGAGGCG |
| 3741 | SPAC26A3.11_DN | CGCCACCTCCAGCCGAAACT |
| 3742 | SPAC26A3.12c_UP | GCACTGGCGTGTAAGCAGAC |
| 3743 | SPAC26A3.12c_DN | ACTTGGAGTGCCCCGAAGAG |
| 3744 | SPAC26A3.13c_UP | AAAGCGGGGCAGGACTACGG |
| 3745 | SPAC26A3.13c_DN | CGCAGGGTGAGGGGAGGAGG |
| 3746 | SPAC26A3.14c_UP | CGGCACCCGGGGGATAAGTC |
| 3747 | SPAC26A3.14c_DN | CACTCCGCACCTCCGTTCAC |
| 3748 | SPAC26A3.15c_UP | GAATCGGGAAGGGCGGAAA |
| 3749 | SPAC26A3.15c_DN | TGGGCAGGCGGTAGGGGTTC |
| 3750 | SPAC26A3.16_UP | CAGCCCCTAACGAAGCCACC |
| 3751 | SPAC26A3.16_DN | TCCCCACCCCTCAGTCCAAG |
| 3752 | SPAC26F1.02_UP | CCAGGTGCGCGGGTTGACAT |
| 3753 | SPAC26F1.02_DN | AATACGTTCCGGCGACCCCT |
| 3754 | SPAC26F1.03_UP | CCAAGGGGGCGGATTCAACA |
| 3755 | SPAC26F1.03_DN | TGGGCCTTTTCCGGTCTGGG |
| 3756 | SPAC26F1.04c_UP | GTTGCGGCGTCTTCGTCTCG |
| 3757 | SPAC26F1.04c_DN | CCTACCGCGATTGGCCAGTT |
| 3758 | SPAC26F1.05_UP | CGGGCACCGACTGTAGTGTT |
| 3759 | SPAC26F1.05_DN | GCGCAGGGCCAAAACATTCT |
| 3760 | SPAC26F1.07_UP | AGCGCGCGAGGCAAAAAGTG |
| 3761 | SPAC26F1.07_DN | GTCGTGGAGGTGCCGTGAAG |
| 3762 | SPAC26F1.08c_UP | TGGCATGCGGGGAACTTTC |
| 3763 | SPAC26F1.08c_DN | GCCCTCTTGGCGGGATCAATC |
| 3764 | SPAC26F1.09_UP | CAGCGTGCGGCCTCAATCTA |
| 3765 | SPAC26F1.09_DN | GGCCAAACCGCACTCACATT |
| 3766 | SPAC26F1.10c_UP | TGGGTAGCGTGTGTGGCGTT |
| 3767 | SPAC26F1.10c_DN | CCACCTCCCGCACGACTTCA |
| 3768 | SPAC26F1.11_UP | CAGGGTGTGAGCCTAATCGAA |
| 3769 | SPAC26F1.11_DN | AGGGCGGACTTCTTGGGCTA |
| 3770 | SPAC26H5.02c_UP | CACCACGACCGAACCACGCA |
| 3771 | SPAC26H5.02c_DN | TCCCCTCGTGTTTGCTTGCG |
| 3772 | SPAC26H5.03_UP | TCGGAAAGCGGCGGTGAATA |
| 3773 | SPAC26H5.03_DN | ATCAACCCCGCTCAGGCGAA |
| 3774 | SPAC26H5.04_UP | AACGGAAAGAAACGCGACGG |
| 3775 | SPAC26H5.04_DN | GCTCGCTACTGCCCTCTCGC |
| 3776 | SPAC26H5.05_UP | TTGCCATCCAGTCGATCCGG |
| 3777 | SPAC26H5.05_DN | TCCTCGCCAGCCTCCTGAAC |
| 3778 | SPAC26H5.06_UP | AGGCAACCGGCGAGCATCAC |
| 3779 | SPAC26H5.06_DN | TGCGGACCATAAGCGGGTTG |
| 3780 | SPAC26H5.07c_UP | ATACGGCAGATGCGTACCCG |
| 3781 | SPAC26H5.07c_DN | GGTGCATTGGCGTTAGGGGG |
| 3782 | SPAC26H5.08c_UP | CCCGGCGTCAACTTTTCCTG |
| 3783 | SPAC26H5.08c_DN | CGACCCCTAAGATGACGCG |
| 3784 | SPAC26H5.09c_UP | AAACGCCCCTCACTTCCCG |
| 3785 | SPAC26H5.09c_DN | AGAATTTGAAGCGCGGGACG |
| 3786 | SPAC26H5.10c_UP | CCACTCGCACGAGTCCTCCA |
| 3787 | SPAC26H5.10c_DN | GCAAAGGCGCATCACCTCAG |
| 3788 | SPAC26H5.11_UP | GCCAAGTCAAACCGCCGTCC |
| 3789 | SPAC26H5.11_DN | TTACCTCCGTGACCTGCCCC |
| 3790 | SPAC26H5.13c_UP | AAACCATSCGGCCTCAACCC |
| 3791 | SPAC26H5.13c_DN | CCCCGGACACCTACGAGCCC |
| 3792 | SPAC27D7.02c_UP | TGGACTGAACCGATCGCTCG |
| 3793 | SPAC27D7.02c_DN | AAAGCCGGCGCCTAATGAACG |
| 3794 | SPAC27D7.03_UP | AGGACTGTGCCGGGAGTGGT |
| 3795 | SPAC27D7.03c_DN | CCCTCACCACCGCCGTAATG |
| 3796 | SPAC27D7.04_UP | AGGAGGTGGGGCGAGACATG |
| 3797 | SPAC27D7.04_DN | TGCCCGCACATACCCTCACA |
| 3798 | SPAC27D7.05c_UP | CGTTCGTCCCTTAGCGCTCG |
| 3799 | SPAC27D7.05c_DN | GCCCGGCCTCAGCAACACAC |
| 3800 | SPAC27D7.06_UP | CCGGCAAGCATTGGATGGTG |
| 3801 | SPAC27D7.06_DN | AGAGGGCTCCGGTTGAAGGG |
| 3802 | SPAC27D7.07c_UP | GCGTGGGGGAGTTTGGCATT |
| 3803 | SPAC27D7.07c_DN | CTAAAGCCACCAACCCCCGC |
| 3804 | SPAC27D7.08c_UP | AGCTTATTCGCACCCTCCCC |
| 3805 | SPAC27D7.08c_DN | GCCCATTCGTCCTTGCAATC |
| 3806 | SPAC27D7.09c_UP | CGCACGAACTAACGCCCCCA |
| 3807 | SPAC27D7.09c_DN | CCAGTTCGGGGGCTTATC |
| 3808 | SPAC27D7.10c_UP | GTTAATCGGGCAGACGGGGA |
| 3809 | SPAC27D7.10c_DN | ACCGGTTCTCCGTCTGCCAA |
| 3810 | SPAC27D7.11c_UP | GGAGCCGCACCCCATTAAGG |
| 3811 | SPAC27D7.11c_DN | CGGCCACGAGGGAAAAACGG |
| 3812 | SPAC27D7.12c_UP | GGGGTACCAGGCAGCGATTC |
| 3813 | SPAC27D7.12c_DN | ATGCGGGCAGGGAAAAAGCAG |
| 3814 | SPAC27E2.01_UP | TTCGGCAACTGTCGGAGCAC |
| 3815 | SPAC27E2.01_DN | ATAGCCACGGCTCACTAGGC |
| 3816 | SPAC27E2.02_UP | CCATCTGCGGCCTTCCAACA |
| 3817 | SPAC27E2.02_DN | ACGGCCGCGCTGACAACTAT |
| 3818 | SPAC27E2.03_UP | CACGCAATCCCTGAGTCCGA |
| 3819 | SPAC27E2.03c_DN | CTTCGCGGAGGTGTTAGGTA |
| 3820 | SPAC27E2.04c_UP | TTTAGTCCCGCCAACGTCCG |
| 3821 | SPAC27E2.04c_DN | AATCAGCCGTGACCCGTAGC |
| 3822 | SPAC27E2.05_UP | CAGCGTGGTTTTCGGCGGTC |
| 3823 | SPAC27E2.05_DN | TTGTCTCCCGCCCCCATTT |
| 3824 | SPAC27E2.06c_UP | AACGGGCGGCGAGACACTCA |
| 3825 | SPAC27E2.06c_DN | TGCCGGGTTGGTGCTTGGTC |
| 3826 | SPAC27E2.07_UP | GTGAGTCTGGTGTGTTGCGG |
| 3827 | SPAC27E2.07_DN | TGCCTCTCCTGCCTCACCCC |
| 3828 | SPAC27E2.09_UP | GCGGCCGACGAAACCGTTAGC |
| 3829 | SPAC27E2.09_DN | AGGGCAGGCACGACGAGA2G |
| 3830 | SPAC27F1.03c_UP | GCCCCCGTCTGTCCGATAAA |
| 3831 | SPAC27F1.03c_DN | GGACATCGATGCGGGCGTGG |
| 3832 | SPAC27F1.04c_UP | GTTCGCAGGTGGGCTTCGCT |
| 3833 | SPAC27F1.04c_DN | CCCCATAACAAGGCGAAGCC |
| 3834 | SPAC27F1.05c_UP | AACCGGATACGCTGTCGCGGG |
| 3835 | SPAC27F1.05c_DN | CTGCAAACGCGGGCTAACA |
| 3836 | SPAC27F1.06c_UP | GGCAAAAGATCGCACACAGG |
| 3837 | SPAC27F1.06c_DN | TGCCCTTGCCGTCATCTCTGA |
| 3838 | SPAC27F1.07_UP | GATAGCGGAATTGCGCAGGG |
| 3839 | SPAC27F1.07_DN | ACCCGTTGGCGGAAGAGTCA |
| 3840 | SPAC27F1.08_UP | CGCACGCCCCAGTCAAGAAC |
| 3841 | SPAC27F1.08_DN | GGGGCAAGAGGGGTTAGGGC |
| 3842 | SPAC27F1.09c_UP | TGTGTGAGGGTGGGTGCGGA |
| 3843 | SPAC27F1.09c_DN | ACTTTGCCCCACGACCGAAA |
| 3844 | SPAC27F1.10_UP | GTTCGCCATGTGACAGCTCC |
| 3845 | SPAC27F1.10_DN | CGCGCTCAGCCTAGAGTACA |
| 3846 | SPAC29A4.02c_UP | ATGCGCACCTAGGTCAGTCC |
| 3847 | SPAC29A4.02c_DN | AACGGTCGGTCCCGGGATTTT |
| 3848 | SPAC29A4.03c_UP | GCCATGGGGAGCCGGGAATA |
| 3849 | SPAC29A4.03c_DN | GCCGGTGTTTGCAGGATGGC |
| 3850 | SPAC29A4.04c_UP | CATGCGCCAACCCTCTGTGT |
| 3851 | SPAC29A4.04c_DN | CGCGGGAACAAAGCCTGCAT |
| 3852 | SPAC29A4.05_UP | AACCCACCCACCACAAGGCA |
| 3853 | SPAC29A4.05_DN | AACGAAGTGGCGAGGCGAGA |
| 3854 | SPAC29A4.07_UP | ATCCGTTCGCTGCCCAACTT |
| 3855 | SPAC29A4.07_DN | AAAATGCCGGCAAGACGGTT |
| 3856 | SPAC29A4.08c_UP | GACAATCGCGAGGGAAACGG |
| 3857 | SPAC29A4.08c_DN | TGGTGGGTTGACGTCGAGCG |
| 3858 | SPAC29A4.09_UP | CCTAGGCCGGCGTTCTTGCT |
| 3859 | SPAC29A4.09_DN | TGCCTTGGCGTAGGTGTCGG |
| 3860 | SPAC29A4.10_UP | ACTCTGACCGCCCCCGACTT |
| 3861 | SPAC29A4.10_DN | TCGTCCAGAGTTCACCGCCC |
| 3862 | SPAC29A4.11_UP | TCAGATCGGGGAACGAGGCT |
| 3863 | SPAC29A4.11_DN | TGCTGTGGGGACGTACTCCA |
| 3864 | SPAC29A4.12c_UP | CCGCACCCATACAACGCCCT |
| 3865 | SPAC29A4.12c_DN | TCCCACAATCCGACACGCCC |
| 3866 | SPAC29A4.13_UP | CTACGCGCGCAAGGATGGAT |
| 3867 | SPAC29A4.13_DN | TCGCCGCAAATCGTCCTTGA |
| 3868 | SPAC29A4.15_UP | CCAGTCCACCACCGCAGGAA |
| 3869 | SPAC29A4.16_UP | TGGACAACCTACCGCAGCGC |
| 3870 | SPAC29A4.19_UP | GCCCCTCAAACCACGATCGC |
| 3871 | SPAC29A4.19_DN | TATCCCCGCCCCTCGTCCCAT |
| 3872 | SPAC29A4.19c_UP | GCAGATGGAGGAACGAGGGG |
| 3873 | SPAC29A4.19c_DN | AGCAGGTCTAACCGGTCCGT |
| 3874 | SPAC29A4.20_UP | CCTGTATTGCGCGTTCCGGG |
| 3875 | SPAC29A4.20_DN | AACCACGCGATCCACCAACG |
| 3876 | SPAC29B12.02c_UP | ACGCCTAGACCCTCGCCAC |

FIG.26

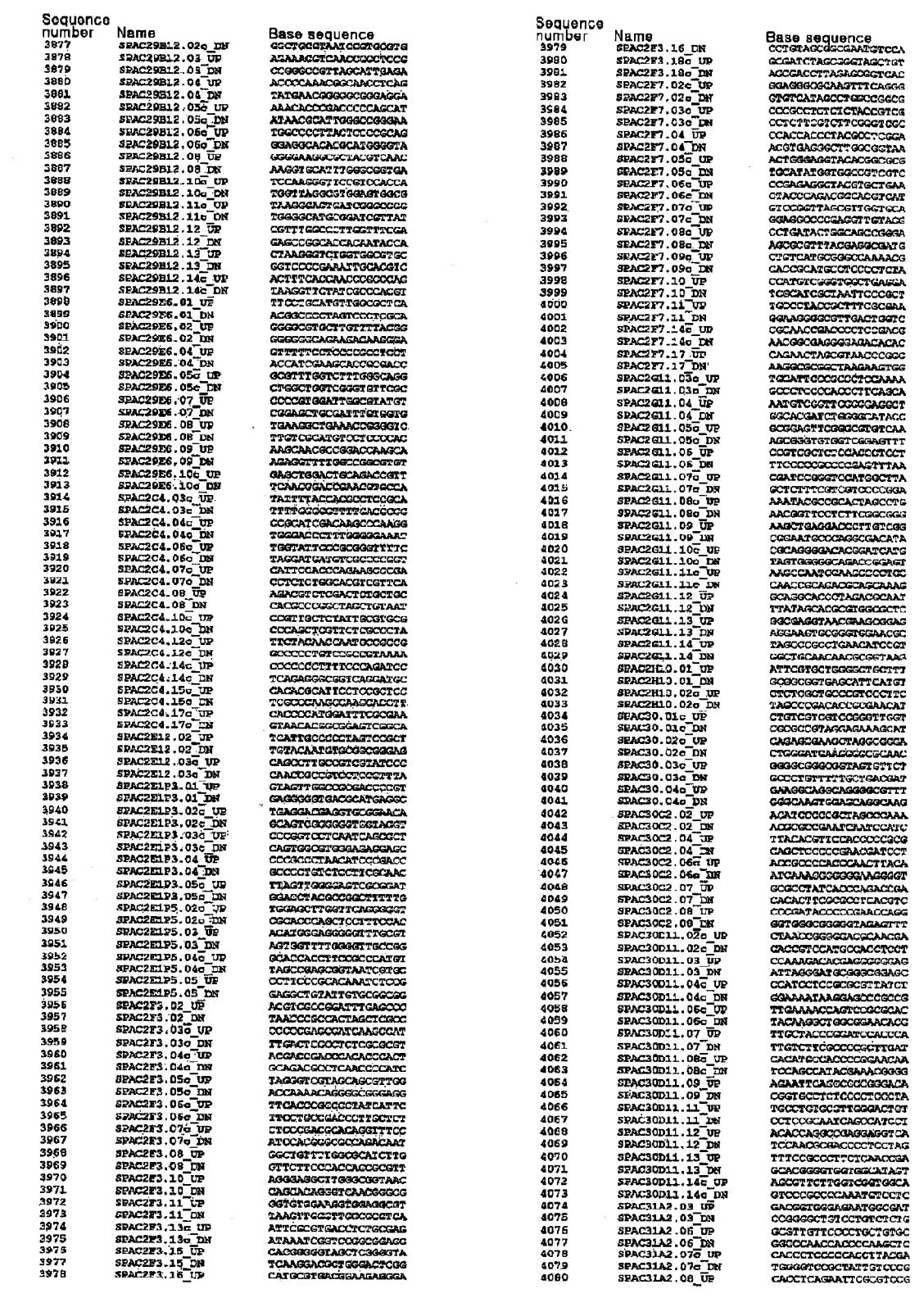

This figure is a large table of DNA sequence data that is too small and low-resolution to transcribe reliably.

FIG.27

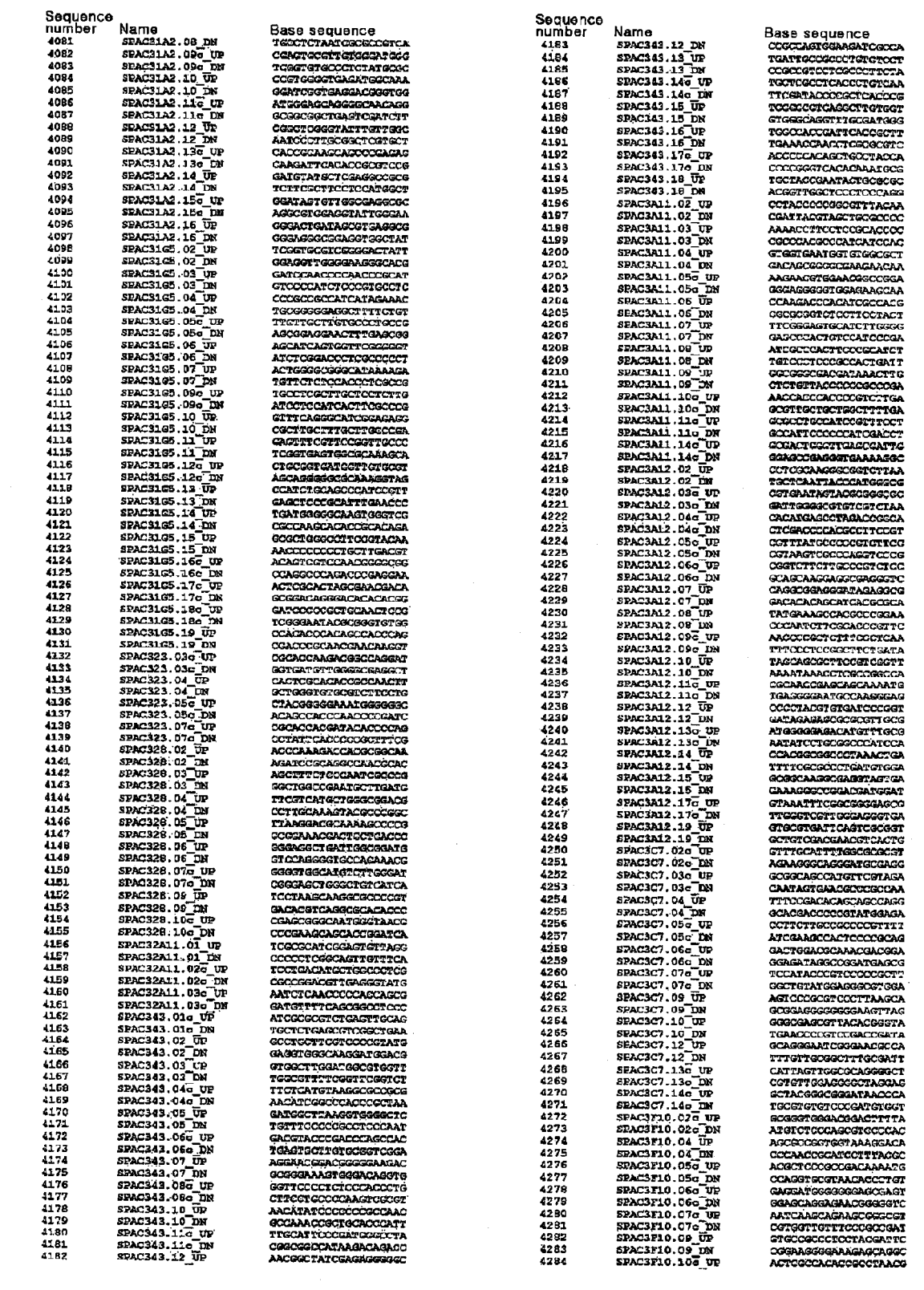

This page consists of a large table of DNA sequence data that is too dense and low-resolution to transcribe reliably.

| Sequence number | Name | Base sequence |
|---|---|---|
| 4489 | SPAC4F8.06_DN | ATCCCACCTTAGCCCCCCGGC |
| 4490 | SPAC4F8.08_UP | ACAACACGACGCCGCCAGAA |
| 4491 | SPAC4F8.08_DN | CTAGCTTGCGCCGGTTTGG |
| 4492 | SPAC4F8.10c_UP | GGCAACGATCCACGAGCCG |
| 4493 | SPAC4F8.10c_DN | GTTTACCGAACCCCCACGGC |
| 4494 | SPAC4F8.11_UP | ATGCAGTTGGTCCTCGGCAG |
| 4495 | SPAC4F8.11_DN | AAGCCGCTCGACGATCACTC |
| 4496 | SPAC4F8.12c_UP | CGTGCGACTTAGTTCCCGGT |
| 4497 | SPAC4F8.12c_DN | TGGAGCTTTCGCCGCTACAA |
| 4498 | SPAC4F8.13c_UP | ATAGTTTCGACCCGCCGCCG |
| 4499 | SPAC4F8.13c_DN | GGGCCCTTTCACTTGCGATA |
| 4500 | SPAC4G8.03c_UP | ATACGGGGGAGTGGGTGCGA |
| 4501 | SPAC4G8.03c_DN | AGCAAAAGCGGAAAGAGGGG |
| 4502 | SPAC4G8.04_UP | ACCCCCATGTAGCCCGCAGT |
| 4503 | SPAC4G8.04_DN | CCACGGGGCTTGCATCACAA |
| 4504 | SPAC4G8.05_UP | GCAACCAATCGGCTACGGCG |
| 4505 | SPAC4G8.05_DN | ACTCCGGTTAGACTCCTGGC |
| 4506 | SPAC4G8.06c_UP | GCCCCTTGTCTGGTCCGGTG |
| 4507 | SPAC4G8.06c_DN | CACCCTCCCTCGTCTGCTCG |
| 4508 | SPAC4G8.07c_UP | ATTCCAGCAGGGGGTGGGTT |
| 4509 | SPAC4G8.07c_DN | CCCCCCCCGAGAAACCACTA |
| 4510 | SPAC4G8.08_UP | CAACTGCCACAACCCCCCA |
| 4511 | SPAC4G8.08_DN | GGGGCCGGAAGGGATATTGT |
| 4512 | SPAC4G8.09_UP | AGCTACCCTCCGGGGCAATA |
| 4513 | SPAC4G8.09_DN | TGGTCTGACGGCGTCGATGA |
| 4514 | SPAC4G8.10_UP | TGGACGTAACGCGGCTACAA |
| 4515 | SPAC4G8.10_DN | ACACTCGCGGCTGAGTACAA |
| 4516 | SPAC4G8.11c_UP | TTATGGCTCCCACGGCGGTG |
| 4517 | SPAC4G8.11c_DN | CGATCAAGGGTCGTACCGGC |
| 4518 | SPAC4G8.12c_UP | GACGATGGTAGCCCGGTCAT |
| 4519 | SPAC4G8.12c_DN | AGCTCCCACCCCTGTCCATG |
| 4520 | SPAC4G8.13c_UP | CTACAAGAGCGGCGACCCGT |
| 4521 | SPAC4G8.13c_DN | TCAAATCGCTCTTCCGCGCA |
| 4522 | SPAC4G9.02_UP | CGCGGCATAAAACGGCCATA |
| 4523 | SPAC4G9.02_DN | TGCATCCGAACAGAAGGATA |
| 4524 | SPAC4G9.04c_UP | CGGTATCGTCCCGCTTCTGG |
| 4525 | SPAC4G9.04c_DN | CGCTCTCCCGAACCCGCATA |
| 4526 | SPAC4G9.05_UP | TCTGGAGGGACGAGGGGTCA |
| 4527 | SPAC4G9.05_DN | TGGCTGAGGGAGGGCGAGT |
| 4528 | SPAC4G9.06c_UP | ATCGCACTCCCCACTGACC |
| 4529 | SPAC4G9.06c_DN | TCCGACAACGGGCTCTCAAA |
| 4530 | SPAC4G9.07_UP | GGAGGGCTGTTGAAGGGACG |
| 4531 | SPAC4G9.07_DN | TGCGTCCCATCCCGTTCTGT |
| 4532 | SPAC4G9.08c_UP | TTTCACCCGCCCCACTCTTT |
| 4533 | SPAC4G9.08c_DN | GTTTCGTATTCGCGACGGCC |
| 4534 | SPAC4G9.09c_UP | CAGATGGCGAGGAGGGGGTG |
| 4535 | SPAC4G9.09c_DN | TGGAGTCATGGGGGTTGCAG |
| 4536 | SPAC4G9.10_UP | CCATAAATCCCTCCGTGCGC |
| 4537 | SPAC4G9.10_DN | GGCTCGTGTTGGATAGGGCG |
| 4538 | SPAC4G9.11c_UP | ATGGCCGGGTGCTTCTGGAA |
| 4539 | SPAC4G9.11c_DN | CACAAGATGAACGCGCCGC |
| 4540 | SPAC4G9.12_UP | TGGATGTGTACGGCCGAGG |
| 4541 | SPAC4G9.12_DN | ATACCGCGCGCCTACATAGC |
| 4542 | SPAC4G9.13c_UP | TGGGAACAAGCGGGGAAGC |
| 4543 | SPAC4G9.13c_DN | TACGTTGCCCCCGAGCTGA |
| 4544 | SPAC4G9.14_UP | TGTGATGCACTGTCCCGCCA |
| 4545 | SPAC4G9.14_DN | CGGCCGAGGTGGGTTGGTCT |
| 4546 | SPAC4G9.15_UP | TCCAGCCAAACAAAGCCCGC |
| 4547 | SPAC4G9.15_DN | CTCTCGCAACCCAACCGCCT |
| 4548 | SPAC4G9.16c_UP | TTCCGCCCTACTCGTTTCCC |
| 4549 | SPAC4G9.16c_DN | CCTCCGGAACAATCGCCTC |
| 4550 | SPAC4G9.17c_UP | CCCAGTCAAACCCCAACGCA |
| 4551 | SPAC4G9.17c_DN | TGTGCTGCCTCCACCATTCG |
| 4552 | SPAC4G9.19_UP | AACTGGCTCCTGATGA |
| 4553 | SPAC4G9.19_DN | CTAACGTGCCGGCTGTACAA |
| 4554 | SPAC4G9.20c_UP | TAGACGCGCAGCGAGAGCC |
| 4555 | SPAC4G9.20c_DN | AGTTGGGTGGTGAAGCGGCG |
| 4556 | SPAC4H3.01_UP | ACCTGCTGCTTGTGCCTCGC |
| 4557 | SPAC4H3.01_DN | ACCCCCCACCTTTGCTCGAG |
| 4558 | SPAC4H3.02c_UP | GAGTTCGCAAGGCGCCCAGT |
| 4559 | SPAC4H3.02c_DN | CCAGCCCCCCTCCACTCTCC |
| 4560 | SPAC4H3.03c_UP | GAGCTTCTGCGTGGGGGGTA |
| 4561 | SPAC4H3.03c_DN | GTACGCCCCATCAAGTCGC |
| 4562 | SPAC4H3.04c_UP | GCGAGCGACTTGGCGGTTTG |
| 4563 | SPAC4H3.04c_DN | ATGATGGGGTTCCGGGATT |
| 4564 | SPAC4H3.05_UP | CCGGTTCTCAGCGTTCCCAT |
| 4565 | SPAC4H3.05_DN | TTTTGAGGTCGTGTCCGGC |
| 4566 | SPAC4H3.07c_UP | CCCCCTGGAACTTCTGCTCG |
| 4567 | SPAC4H3.07c_DN | TAAACAGCCGAGCCCCCACC |
| 4568 | SPAC4H3.08_UP | TACCGGGTCTCGCTGTACAA |
| 4569 | SPAC4H3.08_DN | AGCGAACTCGTACACCCTG |
| 4570 | SPAC4H3.10c_UP | ACGCTGACGGCTCGAGTTACA |
| 4571 | SPAC4H3.10c_DN | TGTACACGGCGTCACGATGA |
| 4572 | SPAC4H3.12c_UP | TTCAAGATCCTCCGCCACCGG |
| 4573 | SPAC4H3.12c_DN | CAGAAAACACCCCGCAAGGCA |
| 4574 | SPAC4H3.13_UP | TGGCGCGTCACAACAGGATGA |
| 4575 | SPAC4H3.13_DN | GCACGTTGACGGCTCGTACAA |
| 4576 | SPAC4H3.14c_UP | GGGGCTCCGGGCATTCAGTC |
| 4577 | SPAC4H3.14c_DN | GCCCACCTTCCGCACGACCT |
| 4578 | SPAC513.02_UP | ATGCTACCGTGTACTGCGAC |
| 4579 | SPAC513.02_DN | AGGCGGGAAGGGCGGTGTTA |
| 4580 | SPAC513.03_UP | GCGGTCGGATTGTTGCTCTC |
| 4581 | SPAC513.03_DN | CCTCTGACATGCCCGCGGTA |
| 4582 | SPAC513.04_UP | ACTGACACACCCCGCCAAA |
| 4583 | SPAC513.04_DN | AAGGAACGGCGGCAGAAAGG |
| 4584 | SPAC513.05_UP | AAGTGTGCCCCCAAACGGTC |
| 4585 | SPAC513.05_DN | CGTCCCTTCTCGCCGTGCCT |
| 4586 | SPAC513.06_UP | ACTGGTTAGGCGTCGATGA |
| 4587 | SPAC513.06c_DN | GGATGCTCACGCGTCCGGC |
| 4588 | SPAC513.07_UP | CCAAAACCCCGGGATGCGCTA |
| 4589 | SPAC513.07_DN | GCCGCTTGTTCGACGTTCAG |
| 4590 | SPAC521.02_UP | CGGCAACACCTCTCCACCCCG |

| Sequence number | Name | Base sequence |
|---|---|---|
| 4591 | SPAC521.02_DN | ATGCCCACCCTGTTCCTGCG |
| 4592 | SPAC521.03_UP | CGCCATCCACGAAGACGACCA |
| 4593 | SPAC521.03_DN | CAGCTTATGATGGGGGCGGC |
| 4594 | SPAC521.04c_UP | GATGGGCTCGTGGGGTGAGA |
| 4595 | SPAC521.04c_DN | GGGTGCGGGAGTGTTGTGGA |
| 4596 | SPAC521.05_UP | CGAACCGGCACGGGGCTATT |
| 4597 | SPAC521.05_DN | CGGGATTCGAGAGCCGTGCAC |
| 4598 | SPAC56E4.02c_UP | AGGTCTGCACGGCTGTACAA |
| 4599 | SPAC56E4.02c_DN | ATAGAGCGCCGGCGTACAA |
| 4600 | SPAC56E4.03_UP | GGAAGGCAATTGTCGGCGTG |
| 4601 | SPAC56E4.03_DN | CGCCCTTGCGAGTTTGGGTG |
| 4602 | SPAC56E4.04c_UP | TCCACATCTCATCGCCCACG |
| 4603 | SPAC56E4.04c_DN | GATACTTGCGGGCGGCTA |
| 4604 | SPAC56E4.05_UP | TTGAGCTTGACTGGCCCCGG |
| 4605 | SPAC56E4.05_DN | CGGGCGTACAAGGGGACACA |
| 4606 | SPAC56E4.06c_UP | GGAGTGCGGGCGGAAAAAG |
| 4607 | SPAC56E4.06c_DN | TTCAGTCACCACCCGCCCAT |
| 4608 | SPAC56E4.07_UP | CATGAGGAGTTCGACGGGCA |
| 4609 | SPAC56E4.07_DN | CGCAGCTCAACCGTCACCCC |
| 4610 | SPAC56F8.02_UP | GACCCGACACACGCCCAGGA |
| 4611 | SPAC56F8.02_DN | ATATAACGTCCCCGCGCCTG |
| 4612 | SPAC56F8.03_UP | CAAAACGGCGAGACGGTAAC |
| 4613 | SPAC56F8.03_DN | TTGGGGTTGGGCTGCTAAGGT |
| 4614 | SPAC56F8.04c_UP | CAACCCGTAAAATGCGCCAA |
| 4615 | SPAC56F8.04c_DN | GGGAAGGGGATAGCGACGAGC |
| 4616 | SPAC56F8.05c_UP | CGACAGACGACGAAACCGCC |
| 4617 | SPAC56F8.05c_DN | GCAGCCACGCGGAACAACCCTA |
| 4618 | SPAC56F8.06c_UP | GTCCCGGCGATTCAGAGCCT |
| 4619 | SPAC56F8.06c_DN | GGCAGCTGTGGGAGGTACCC |
| 4620 | SPAC56F8.08_UP | CTCCAAACACCCTCCCGCGT |
| 4621 | SPAC56F8.08_DN | CCCTGAACCCCCTGCTACGC |
| 4622 | SPAC56F8.09_UP | GGCTTGCTCGGGGGTTCACT |
| 4623 | SPAC56F8.09_DN | AAGGTGGAACAGCGAGCCCC |
| 4624 | SPAC56F8.10_UP | CATGCGGCGTCCGATGATGA |
| 4625 | SPAC56F8.10_DN | TGGGTTCAACGCGGCTACAA |
| 4626 | SPAC56F8.11_UP | AACGCCTCACCTCCCAACCA |
| 4627 | SPAC56F8.11_DN | GCTGGGAAAGCGAGGGTGTC |
| 4628 | SPAC56F8.12_UP | CCAGGATCGGCTGCTACAA |
| 4629 | SPAC56F8.12_DN | GTAGTTCATTGGCGCGAGC |
| 4630 | SPAC56F8.14c_UP | CGGGTTTGAGCGTGCGATTA |
| 4631 | SPAC56F8.14c_DN | GCGCAGAGGTTCAAAAGGGG |
| 4632 | SPAC56F8.15_UP | ACCTCCGCAATCCGCTTTCA |
| 4633 | SPAC56F8.15_DN | TACACAGCCAGAACCGCCGA |
| 4634 | SPAC57A10.02_UP | TGTGTTCGGCCTGTTGCCTG |
| 4635 | SPAC57A10.02_DN | GGTGGGAATGAGGTGAGGCG |
| 4636 | SPAC57A10.03_UP | CAGCAGCCCACTTCCTCCGA |
| 4637 | SPAC57A10.03_DN | GCGCCGGTGATTCGGATCT |
| 4638 | SPAC57A10.04_UP | CCCGATGCTCTCCCGTCCAA |
| 4639 | SPAC57A10.04_DN | GGCGTTATTGGTGCTGCGAA |
| 4640 | SPAC57A10.05c_UP | CCGTTCCCCTCACATACGCC |
| 4641 | SPAC57A10.05c_DN | GATTCGCGGGGTTAGGCGAA |
| 4642 | SPAC57A10.06_UP | ACTCTAGGCGTCGCGGATGA |
| 4643 | SPAC57A10.06_DN | GTCTGGACATCCGGCGATGA |
| 4644 | SPAC57A10.07_UP | TTCGCGGCCTCTTGTCGCTCT |
| 4645 | SPAC57A10.07_DN | AGGCTCATCCACTCGCTGCA |
| 4646 | SPAC57A10.08c_UP | AACAGGGGGTTCGTCAGCA |
| 4647 | SPAC57A10.08c_DN | GGCGGCATAGGGGACTAGGG |
| 4648 | SPAC57A10.09c_UP | CTTTGCCTGCGCGGGTTCTA |
| 4649 | SPAC57A10.09c_DN | TGCATCTGCGCTGAATCCTT |
| 4650 | SPAC57A10.10c_UP | GCTGGGAACGGGACGCAAGA |
| 4651 | SPAC57A10.10c_DN | TGGGGTGCGGGCCTTCTAAAG |
| 4652 | SPAC57A10.12c_UP | CAGAACATGTCGGAGTGCCG |
| 4653 | SPAC57A10.12c_DN | ACTGCAGCCCGCTGCTACAA |
| 4654 | SPAC57A10.14_UP | TCGACATGCCGCACGAGTGT |
| 4655 | SPAC57A10.14_DN | GCTCCAGTCAGGTGATCGCT |
| 4656 | SPAC57A7.04c_UP | GCCCCCACCCGAAGACAAGC |
| 4657 | SPAC57A7.04c_DN | TCGGAGATGAATGGGGCCCT |
| 4658 | SPAC57A7.05_UP | TTGTTGTACGGGGCTGGGGC |
| 4659 | SPAC57A7.05_DN | CTGAAGGTTTTTGGGGGCGG |
| 4660 | SPAC57A7.07c_UP | TTCGTTCTCGGGGATGGTTG |
| 4661 | SPAC57A7.07c_DN | CTGTTTCGCGCCACGTGTCC |
| 4662 | SPAC57A7.08_UP | TGGTGTTGCCGACTGCGCTT |
| 4663 | SPAC57A7.08_DN | CCCATTGGTGCACGTCCGGT |
| 4664 | SPAC57A7.09_UP | TCAACTTCGCTGCTGCCGTG |
| 4665 | SPAC57A7.09_DN | CTACGCTGGGTGCGGACCGT |
| 4666 | SPAC57A7.10c_UP | CATAACGCCAATCGGCGAA |
| 4667 | SPAC57A7.10c_DN | GGGTGGCTTGGATGTTTGGC |
| 4668 | SPAC57A7.12_UP | GCTACCAGACAAGGCCGCCC |
| 4669 | SPAC57A7.12_DN | GCCGGTTCCGACCAACTCTC |
| 4670 | SPAC57A7.13_UP | CGTTCATCCCCTTCACCGCA |
| 4671 | SPAC57A7.13_DN | TACGGGGGGCAAGTTCAGGG |
| 4672 | SPAC589.02c_UP | CCCAGCCCCAGAACAACGGT |
| 4673 | SPAC589.02c_DN | AGCCCFTTCAGTCCCCGGCT |
| 4674 | SPAC589.03c_UP | CGGCGTGTGCGTAGGGTGTG |
| 4675 | SPAC589.03c_DN | CGGCGATAGTGGAGTTTCAA |
| 4676 | SPAC589.05c_UP | ACCACTCAATCACGCCCGGG |
| 4677 | SPAC589.05c_DN | GGACCGGCTTTACCTGCCCC |
| 4678 | SPAC589.06c_UP | AGAGCAGGTTTCGGTGCGGC |
| 4679 | SPAC589.06c_DN | ACAGCGGGCGAAAAGTCC |
| 4680 | SPAC589.07c_UP | GTTCGTGATGCCCGGGTTGA |
| 4681 | SPAC589.07c_DN | AGGCCCCGAAACAAACCGCT |
| 4682 | SPAC589.08c_UP | ACGCGGGTCCATACTGAGGC |
| 4683 | SPAC589.08c_DN | ATAGCGGCGTGGTGGAGGCA |
| 4684 | SPAC589.09_UP | GCGAGTTGGCAGGCGGACAGT |
| 4685 | SPAC589.09_DN | GCAATGGGGCGTCGTTACCT |
| 4686 | SPAC589.10c_UP | GCAGGCGAGGGACTGTTTGT |
| 4687 | SPAC589.10c_DN | CGTGCGTGTTTGTGCTCCC |
| 4688 | SPAC5D6.01_UP | TGCATTTCTCTAGCGCGCG |
| 4689 | SPAC5D6.01_DN | TCCAGGTGCGCGTTTCGTTC |
| 4690 | SPAC5D6.02c_UP | ACTATGCGTTTGAACGGGC |
| 4691 | SPAC5D6.02c_DN | AGAGGTAGGGCGCATGGGGG |
| 4692 | SPAC5D6.04_UP | GCTGGTGGACTCCGTACAA |

FIG.30

| Sequence number | Name | Base sequence |
|---|---|---|
| 4693 | SPAC5D6.04_DN | CATCCTGGGAGGCGTGATGA |
| 4694 | SPAC5D6.05_UP | TTCGTCCCTGTCGTGCCGCG |
| 4695 | SPAC5D6.05_DN | TTCGCGGGCCCACATCTTCA |
| 4696 | SPAC5D6.06c_UP | AACGGCGTGGGAATTCTGCG |
| 4697 | SPAC5D6.06c_DN | CACTGGCTACTTGGGTCGCG |
| 4698 | SPAC5D6.07c_UP | CCAAATATCGCTGCCGGCTG |
| 4699 | SPAC5D6.07c_DN | AGTAACGGGATTGGCGGCTG |
| 4700 | SPAC5D6.09c_UP | GCGGCACCAGAAATCGAACG |
| 4701 | SPAC5D6.09c_DN | ATCGGAAACCCCCAAGCGTG |
| 4702 | SPAC5D6.10c_UP | TCCCGACACGAAAGCACCAG |
| 4703 | SPAC5D6.10c_DN | CGCTATAGGTCCGCCCCGAA |
| 4704 | SPAC5D6.12_UP | AGCTTTGAGTGTCCCCGGTG |
| 4705 | SPAC5D6.12_DN | TGGGGAACGGAGCCACATGT |
| 4706 | SPAC5H10.01_UP | CAGCAGCCGAAAGGCGAAC |
| 4707 | SPAC5H10.01_DN | TGGTGGTGTCGCCGGTCGTCT |
| 4708 | SPAC5H10.02c_UP | CAGGAGGTGGGACGCAAAGC |
| 4709 | SPAC5H10.02c_DN | GCCCAACCCGACATCTTCCC |
| 4710 | SPAC5H10.03_UP | TGATGGATAGCTCGCCGGGT |
| 4711 | SPAC5H10.03_DN | GJAGATTGGCGGGCATCGTGG |
| 4712 | SPAC5H10.04_UP | GSTAAGCATGCGGTGGGCCT |
| 4713 | SPAC5H10.04_DN | TAGCAAGGGGCCGGTCGAAA |
| 4714 | SPAC5H10.05c_UP | AGGGGGCGTGGGATTGAAAG |
| 4715 | SPAC5H10.05c_DN | CACAACGGAAGGGCAGCAAG |
| 4716 | SPAC5H10.06c_UP | CGAAACGAGACGGGCGAGAA |
| 4717 | SPAC5H10.06c_DN | TCGGACGGGCAGGGACTACT |
| 4718 | SPAC5H10.07_UP | ACTTCACGTGCTGCTCCCGA |
| 4719 | SPAC5H10.07_DN | ACTTGTGCAGGGTTCGGCCG |
| 4720 | SPAC5H10.08c_UP | CTGCTTGGGCTGGAGTTGCG |
| 4721 | SPAC5H10.08c_DN | GTCGTCTCCCTTCGCTCCCA |
| 4722 | SPAC5H10.09c_UP | CGGATAGAGGGCGACAGGGT |
| 4723 | SPAC5H10.09c_DN | TAAAGTATGGGACGCGCGGC |
| 4724 | SPAC5H10.10_UP | TCTCCACGCCACCCCCTAAC |
| 4725 | SPAC5H10.10_DN | GCGTGGATTTGCGGGGTGTT |
| 4726 | SPAC5H10.11_UP | AATGTGGCTAGGGTTCGGCG |
| 4727 | SPAC5H10.11_DN | AGCCTGCCGCTCCTGGCTAG |
| 4728 | SPAC5H10.12c_UP | ACAATAACCCCCCCTGCCGA |
| 4729 | SPAC5H10.12c_DN | CCGCCCCGTACAAGCCAGAA |
| 4730 | SPAC5H10.13c_UP | CTCCGGCATTGTAACGCTGC |
| 4731 | SPAC5H10.13c_DN | GGCGAATGTGGGGCGGAAAT |
| 4732 | SPAC607.03c_UP | TGGTGTCTTCTGAGGGGGCG |
| 4733 | SPAC607.03c_DN | AGGCCCAGGAATGCACCAACG |
| 4734 | SPAC607.06c_UP | TTTCACCCCGTCCTCGGTCT |
| 4735 | SPAC607.06c_DN | CCTCGCCCGGCCTCCTGAAA |
| 4736 | SPAC607.07c_UP | ACAGCGGGAGGCACTATCGG |
| 4737 | SPAC607.07c_DN | GCCCCCATCCCTAGTCCCAG |
| 4738 | SPAC607.08c_UP | ATGGGCGTTCCGTGAGTGTG |
| 4739 | SPAC607.08c_DN | CTGGGGACATTGGGAACGGC |
| 4740 | SPAC607.09c_UP | ACCGGCAAAGCAACCACCTC |
| 4741 | SPAC607.09c_DN | TTTATCGAGGGCCAACGCGCA |
| 4742 | SPAC607.10_UP | TGGTAGTCGCCGGCGAAATC |
| 4743 | SPAC607.10_DN | CGGTTGGCGTCGGTGGATTC |
| 4744 | SPAC630.03_UP | ACCCGCAGAAATGCAACCCT |
| 4745 | SPAC630.03_DN | GTCTAACGGGAGCGGGGAGT |
| 4746 | SPAC630.04c_UP | TTGCGGGGGGCCTTCATTGGT |
| 4747 | SPAC630.04c_DN | CGCGTTCAGGCTCAGGGTGC |
| 4748 | SPAC630.05_UP | GAAGGCCCCGTGTGTCGAGC |
| 4749 | SPAC630.05_DN | CCACCAATTGCTGCCCCTTG |
| 4750 | SPAC630.06c_UP | TGGGGGTTCTCACGTGGGCT |
| 4751 | SPAC630.06c_DN | GTGCCCGAATTCAAGCCAGG |
| 4752 | SPAC630.07c_UP | CATACCTCGGCGTCGGATCA |
| 4753 | SPAC630.07c_DN | GATGTGACGGGCGGTCGATG |
| 4754 | SPAC630.08c_UP | CGGAGGAACAGCAATTGACA |
| 4755 | SPAC630.08c_DN | CCGACAACCGCACCAACCGT |
| 4756 | SPAC630.09c_UP | AGTGGCGTGGAAGGGGAGCA |
| 4757 | SPAC630.09c_DN | TCTTTCGTGGTTCTCCCGCC |
| 4758 | SPAC630.10_UP | GGAAGGTGGGATGAAAGTCG |
| 4759 | SPAC630.10_DN | TGAAGGAGTCGCAAAATCGA |
| 4760 | SPAC630.12_UP | CGCTCACCCTTGCTTTGCCG |
| 4761 | SPAC630.12_DN | GTGGGGGCAAGCGGATAAAG |
| 4762 | SPAC630.13c_UP | CTGCGCCTTTTGGGGGAACG |
| 4763 | SPAC630.13c_DN | ACCGGAACAGCACCCTCCAA |
| 4764 | SPAC630.14c_UP | GCGGGCGGTAGAAAGACGGG |
| 4765 | SPAC630.14c_DN | GGGGAGGAATCGGTGAAGCC |
| 4766 | SPAC630.15_UP | TCACGTACGGACCCGGCAAT |
| 4767 | SPAC630.15_DN | ATTGCCTAACGGTGCCCGAA |
| 4768 | SPAC631.01c_UP | GGACGCCTTTACGGACCCAGG |
| 4769 | SPAC631.01c_DN | GCATCGGTGCCCTAACAGGC |
| 4770 | SPAC637.03_UP | GCCCCTCATTGTCACGCCAT |
| 4771 | SPAC637.03_DN | ACGGTGGGAGTGGAGACGGG |
| 4772 | SPAC637.04_UP | CCCACAACCCCCCCCAAGAG |
| 4773 | SPAC637.04_DN | GAATAACGGGGCTTGGGGCA |
| 4774 | SPAC637.05c_UP | CCCGCATTACCGCCACTCTC |
| 4775 | SPAC637.05c_DN | GCCGGTGTCTTTCGCTGTGT |
| 4776 | SPAC637.06_UP | TGCGTGGGCTAAAGTGTACGG |
| 4777 | SPAC637.06_DN | GGATGTGCTCGCCGGTGAGTC |
| 4778 | SPAC637.07_UP | GACCTCCCCGGTCAGCTGC |
| 4779 | SPAC637.07_DN | CAGTACCGCCTTCTCCGCCT |
| 4780 | SPAC637.08_UP | TCAACTAGCCCCACCGACCC |
| 4781 | SPAC637.08_DN | GTTCCCCCGTGATCGACAA |
| 4782 | SPAC637.09_UP | CATCCCACGCACAGAAACAA |
| 4783 | SPAC637.09_DN | ATTTCGTCTTGCGGGGCTTC |
| 4784 | SPAC637.10c_UP | GTGGTGCTGCTGCTCGGCAA |
| 4785 | SPAC637.10c_DN | GTCCCCATCATCACCGCGTT |
| 4786 | SPAC637.11_UP | CGCCCGCATGCTTATTCTCA |
| 4787 | SPAC637.11_DN | TGTCGCCTAGGCCCCAAAGA |
| 4788 | SPAC637.12c_UP | ATACTCGCCGAGGGAACGCC |
| 4789 | SPAC637.12c_DN | TGGGTTACCGAGACGGCGG |
| 4790 | SPAC637.13c_UP | AAATTTTGCGGCAAGGGGG |
| 4791 | SPAC637.13c_DN | GTACCCGCCTTCACCCACCG |
| 4792 | SPAC644.04_UP | CTTGAAGTCGTCCGCCGTGC |
| 4793 | SPAC644.04_DN | GCCTTGGCGCCGTTCTCTT |
| 4794 | SPAC644.05c_UP | TGCGCTGTGCCTCGTGATTG |

| Sequence number | Name | Base sequence |
|---|---|---|
| 4795 | SPAC644.05c_DN | CCTAGAAACCACGGTCAGAG |
| 4796 | SPAC644.06c_UP | GAGCTGCTGCACACCCCCAG |
| 4797 | SPAC644.06c_DN | TTATCGGAAATCGGCCACGC |
| 4798 | SPAC644.07_UP | CCCACCCTCTCACGCTCGCT |
| 4799 | SPAC644.07_DN | TGCGGAATCGGTCGTTCGGT |
| 4800 | SPAC644.08_UP | GTGGCGGTCGGGCGTTTAGA |
| 4801 | SPAC644.08_DN | GAACAAATGAGGGCGGGCA |
| 4802 | SPAC644.09_UP | CTAGCCAACGACCCCCTCCG |
| 4803 | SPAC644.09_DN | GAGTCGCCGGGTTAAGTGGG |
| 4804 | SPAC644.11c_UP | GTTCAATGCTCCGCCGACGCA |
| 4805 | SPAC644.11c_DN | ACCCCGCCCCGTATCCTATC |
| 4806 | SPAC644.12_UP | AAAGGGACGACGGCAGGGAT |
| 4807 | SPAC644.12_DN | AACACAATCATCGCCCCCCA |
| 4808 | SPAC644.13c_UP | TCCCTTGTCGCGCCACTGT |
| 4809 | SPAC644.13c_DN | ACGGATCAGCACCCAGAAGG |
| 4810 | SPAC644.14c_UP | TCTTGTTCCTGTCGCGTGTG |
| 4811 | SPAC644.14c_DN | CGCCACGCCTCACACCATGT |
| 4812 | SPAC644.16_UP | TGGACCCCGCCGCAATCTGAG |
| 4813 | SPAC644.16_DN | ACTTGCGTCTGGCGGGCTAC |
| 4814 | SPAC644.17c_UP | CGCTGACAAAAGCCTCGGCC |
| 4815 | SPAC644.17c_DN | GAGCAGTCGCAACCCACCGG |
| 4816 | SPAC664.02c_UP | CAGAGTGGCGCAACGACGGT |
| 4817 | SPAC664.02c_DN | CGCAGGCCGCTACGTCATTC |
| 4818 | SPAC664.03_UP | ACGCTCGCACACCCACTCA |
| 4819 | SPAC664.03_DN | TCCTGTTTGGCCTGGCTGGA |
| 4820 | SPAC664.04c_UP | ATGGGAAGGCGTGCACTGCCG |
| 4821 | SPAC664.04c_DN | GGGCCTCGACGGAACTAGCA |
| 4822 | SPAC664.05_UP | CGGTCAAGAATCGGCATGGG |
| 4823 | SPAC664.05_DN | CAAAAAGCGGGCAGAGCGGC |
| 4824 | SPAC664.07c_UP | CCGCAATACCGCGTTACCCT |
| 4825 | SPAC664.07c_DN | TTCGGAAGGGAGAAGCCGCC |
| 4826 | SPAC664.09_UP | GACTCGGGGCTTGGGTGAAG |
| 4827 | SPAC664.09_DN | ATCTGTCGGTCGGCTCCTGG |
| 4828 | SPAC664.10_UP | TGTGTCACGCAGGTGCACTA |
| 4829 | SPAC664.10_DN | ACCATCCGACGGCTCTTTG |
| 4830 | SPAC664.11_UP | GCGGGACCTTTGCTGCACGT |
| 4831 | SPAC664.11_DN | CGACATCTCGGCAAAGCGGC |
| 4832 | SPAC664.12c_UP | TAGGCTTCGAGTCCCGGGTT |
| 4833 | SPAC664.12c_DN | TGCTCCTCCCGTGCCTGCTCA |
| 4834 | SPAC664.13_UP | ACCCACTCCGCACCCTGTCA |
| 4835 | SPAC664.13_DN | GATGTCCTGTCTCCCGGCGCC |
| 4836 | SPAC664.14_UP | CGTTGTTCCCTGGTCCCGCA |
| 4837 | SPAC664.14_DN | CCGCAGCCCTAACCCAATGT |
| 4838 | SPAC683.03_UP | ATGCGCCCACTACTAACCCG |
| 4839 | SPAC683.03_DN | AGACGGAACCGGACGTACA |
| 4840 | SPAC688.02c_UP | GGTCGTTTCGTTTCGCGGTT |
| 4841 | SPAC688.02c_DN | TCCCCAGCACAAGACCGCAA |
| 4842 | SPAC688.03c_UP | TCGTCCCGTGCGCCTTTATGA |
| 4843 | SPAC688.03c_DN | TGCCTGCGCGTACGTTTTC |
| 4844 | SPAC688.04c_UP | AGGGGGCGCGGTTGCATATA |
| 4845 | SPAC688.04c_DN | GGACGTTATAGCGGCGAGGC |
| 4846 | SPAC688.06c_UP | CGCGACCCTCACCGATTCCT |
| 4847 | SPAC688.06c_DN | CAAGTGCATCATCGGCCCGT |
| 4848 | SPAC688.06c_DN | CAACAGACCCCGCGATCCGT |
| 4849 | SPAC688.07c_UP | GAACAGACCCCCGCGATCCCT |
| 4850 | SPAC688.07c_DN | TCCTGCAACCCTCTCGAATT |
| 4851 | SPAC688.09_UP | GCGAGGCTCACACATACCCGA |
| 4852 | SPAC688.09_DN | GATTTCCTTCCGCGGCAGCT |
| 4853 | SPAC688.10_UP | TGCCCTCACCACGCACTCAA |
| 4854 | SPAC688.10_DN | ATCGGTCAGGGGTTAGCGGG |
| 4855 | SPAC688.11_UP | GCGAGCCGAAGGTAGTCGGGA |
| 4856 | SPAC688.11_DN | CCCGCAGCGATCAGTTGCCC |
| 4857 | SPAC688.12c_UP | GGCAACAAGCAGCAAAGCGG |
| 4858 | SPAC688.12c_DN | TGGTGTAGGCATCGGGGGCC |
| 4859 | SPAC688.13_UP | CTGGCACCCCGGCTTTTTA |
| 4860 | SPAC688.13_DN | TGGGAACATTTGGGGCACG |
| 4861 | SPAC688.14_UP | CTGTCTAGCGGCGGCCATCT |
| 4862 | SPAC688.14_DN | CCTAACGGGAAGGGTCCCGC |
| 4863 | SPAC694.02_UP | GCGGCAAGGAGGTGTGGCTA |
| 4864 | SPAC694.02_DN | GGCACAAAGCGAGGGGAACA |
| 4865 | SPAC694.05c_UP | TCCGTCGGGCTCAAAAACCT |
| 4866 | SPAC694.05c_DN | TCCGCCCGCCATCTTTCTC |
| 4867 | SPAC694.05c_UP | CACTTGGATCGCCCCCTGT |
| 4868 | SPAC694.05c_DN | GGCGGTTGGGAGAAGGCGAG |
| 4869 | SPAC5B12.02c_UP | CCTACGCCCATTTACCCCCC |
| 4870 | SPAC5B12.02c_DN | TCGTTTCTCTGCGGCTCCCC |
| 4871 | SPAC5B12.03c_UP | GAGTCCCCCACAAGAAGCCG |
| 4872 | SPAC5B12.03c_DN | CAAACCCCCGACTCCAACGC |
| 4873 | SPAC5B12.04c_UP | ACCAGCTAGCCCGCGAAAGA |
| 4874 | SPAC5B12.04c_DN | GGGCTTAATTGGCGACTGTT |
| 4875 | SPAC5B12.05c_UP | AAGAGAGGGCACCGGCCAAA |
| 4876 | SPAC5B12.05c_DN | CTGGTGAGCGGAAAAGCGGC |
| 4877 | SPAC5B12.07c_UP | GTCTTCTCCGCCGCGATTTC |
| 4878 | SPAC5B12.07c_DN | TAGCGAGCCTCAACACGCGG |
| 4879 | SPAC5B12.08_UP | GTTACAGCCCCCGTGCCCTC |
| 4880 | SPAC5B12.08_DN | CAAGCAAAACCTACGCGCGAA |
| 4881 | SPAC5B12.09_UP | CTCCTAGAATGTCCGCGCGC |
| 4882 | SPAC5B12.09_DN | TCTTTTCGGAGGGCGTGGCT |
| 4883 | SPAC5B12.10c_UP | GTGGTCAGGCCGTGTGGCT |
| 4884 | SPAC5B12.10c_DN | CGCTACCCACCCCCGCATTTA |
| 4885 | SPAC5B12.12_UP | TTGGCACGCCTGGAAGCGACG |
| 4886 | SPAC5B12.12_DN | GTGCAGAGGTGTGGTCGGGA |
| 4887 | SPAC5B12.14c_UP | CTACACCCAGCCACATGCCG |
| 4888 | SPAC5B12.14c_DN | GGCGGCTCCCAATCACGAAT |
| 4889 | SPAC5B12.15_UP | GCCAAGCAACTCGGCGGTTG |
| 4890 | SPAC5B12.15_DN | AGCCCGTAGGGCAAAGTGCG |
| 4891 | SPAC5B12.16_UP | CATCTTCCGCGTGCTTGTGC |
| 4892 | SPAC5B12.16_DN | GACTGGTAAGGGAGCGCGGG |
| 4893 | SPAC6C3.02c_UP | CCTTGGGCTGCGGTGGCTTA |
| 4894 | SPAC6C3.02c_DN | CCCATCGTGTCGCCCAGCCT |
| 4895 | SPAC6C3.03c_UP | TCCCCTGCGCTCTCCAAATT |
| 4896 | SPAC6C3.03c_DN | GGGGGCCGATTGATGAAAAA |
| 4897 | SPAC6C3.04_UP | TTGGGTGAGCGGATAGGGCA |

FIG.31

| Sequence number | Name | Base sequence |
|---|---|---|
| 4897 | SPAC6C3.04_DN | GTTGGGGCGGATTCGGAGTA |
| 4898 | SPAC6C3.05_UP | TTACCCCATTATCCGCCCCA |
| 4899 | SPAC6C3.05_DN | AACTTCCAACATGCGGGGGG |
| 4900 | SPAC6C3.06a_UP | ACCAGGGAAGGCGGAAGGT |
| 4901 | SPAC6C3.06a_DN | CACCATATCCCCCAAGTCCC |
| 4902 | SPAC6C3.07_UP | GTGGAAATCGGCTGCGAGGC |
| 4903 | SPAC6C3.07_DN | AGCGCCCGGTAGAGCACTTT |
| 4904 | SPAC6C3.08_UP | GGGCTCCGCGCTTCATAGTC |
| 4905 | SPAC6C3.08_DN | ATCGAATAATGGGCGGCAC |
| 4906 | SEAC6C3.09_UP | TCGCGGGGCCTAAGCATTT |
| 4907 | SPAC6C3.09_DN | GTGGTCCGCGTTCGGAGTAT |
| 4908 | SPAC6F12.02_UP | TTTCCTGGGCCCGTCCTGTA |
| 4909 | SPAC6F12.02_DN | ACCATCCATCTCACGGGCCA |
| 4910 | SPAC6F12.03c_UP | AGAAGCCCTGCGCGATACCC |
| 4911 | SPAC6F12.03c_DN | TGATTTTAGGCCCCGGGATGG |
| 4912 | SPAC6F12.04_UP | ACCTGGGATCGCGTTGGGTA |
| 4913 | SPAC6F12.04_DN | GTTGCGATCGAGTTCCCCGG |
| 4914 | SPAC6F12.06_UP | CCGCCCAATTTAAAAGCTGCC |
| 4915 | SPAC6F12.06_DN | TCACTTTCGGCCGGGGCTTTA |
| 4916 | SPAC6F12.07_UP | TTGGACGGTGGGACAGTGGA |
| 4917 | SPAC6F12.07_DN | GCAGGAGTGTCAGACGTCGG |
| 4918 | SPAC6F12.08c_UP | CCTAAGCAACATCCCCCCGA |
| 4919 | SPAC6F12.08c_DN | AACGCTCCCCATTTCGCTCC |
| 4920 | SPAC6F12.09_UP | CCAATTGAGAACCGCCAGCG |
| 4921 | SPAC6F12.09_DN | CACGGGGGGGGACACTATC |
| 4922 | SPAC6F12.10a_UP | TCAGCTCGGCCACGTTCATT |
| 4923 | SPAC6F12.10c_DN | CCTTGCCCTGTCCATCTCGC |
| 4924 | SPAC6F12.11c_UP | TGCCCCCGATTTACCGATTC |
| 4925 | SPAC6F12.11c_DN | GCCGTGGAGCGTTATGGAGG |
| 4926 | SPAC6F12.12_UP | TTAGGTCAGTGTGGCCGGCA |
| 4927 | SPAC6F12.12_DN | TGACACACCCGTTTTTGCCG |
| 4928 | SPAC6F12.13c_UP | GCCAATATGCGTCACAGGC |
| 4929 | SPAC6F12.13c_DN | TGGCGAGTGCCGTGCATATC |
| 4930 | SPAC6F12.14_UP | GGGGCTGCAAAAGGACGAGG |
| 4931 | SPAC6F12.14_DN | CATAAGGGCACCGTGGGGCT |
| 4932 | SPAC6F12.16a_UP | GCGGGTGAGGAGAGGTGGGT |
| 4933 | SPAC6F12.16c_DN | TCGTCCGCCTCAGTCTTCCG |
| 4934 | SPAC6F12.17_UP | CTGCCCCTAGTTCCGGTCGA |
| 4935 | SPAC6F12.17_DN | TGTTCCCATCTCGCGCTCGT |
| 4936 | SPAC6F6.01_UP | CGGCACCCCGTCGTTCTCTG |
| 4937 | SPAC6F6.01_DN | TGTTTACCGTTCCCCCAGCC |
| 4938 | SPAC6F6.02c_UP | ATTTTGGGGCTGGCTCGGCT |
| 4939 | SPAC6F6.02c_DN | GGGTGGTTCGGGACTGGTGT |
| 4940 | SPAC6F6.03a_UP | ATGGATTCCGCCTCTGTCGC |
| 4941 | SPAC6F6.03c_DN | GCCAGAAAGGGGCTACAAG |
| 4942 | SPAC6F6.04c_UP | CACCTCGGCTGCTTTCCATA |
| 4943 | SPAC6F6.04c_DN | TTCGGCGTTGGAGACAGTTGC |
| 4944 | SPAC6F6.05_UP | ACCGACGCTTTGCCCGATTT |
| 4945 | SPAC6F6.05_DN | ACTCGAAAAGGCCGCCGGATA |
| 4946 | SPAC6F6.06c_UP | AAATCATGCCCCAACCCCC |
| 4947 | SPAC6F6.06c_DN | CCCGTCTTGGTCCATCCACC |
| 4948 | SPAC6F6.07c_UP | TTTGAGCTACCGGTTCGGCA |
| 4949 | SPAC6F6.07c_DN | CCGAGTCGCGAACCTCACAT |
| 4950 | SPAC6F6.08c_UP | GCGCCACAAGGGGACAG |
| 4951 | SPAC6F6.08c_DN | CCAATTGCCCGCTGCTACCC |
| 4952 | SPAC6F6.10c_UP | GGAACCGGGACATAGGCACA |
| 4953 | SPAC6F6.10c_DN | GGCTGTCGGTCGGGGCTACA |
| 4954 | SPAC6F6.11c_UP | TGATTATGTCGCAGGGGCG |
| 4955 | SPAC6F6.11c_DN | AGTGTTTCTGCGGGACGGGA |
| 4956 | SPAC6F6.12_UP | GTGTCCCGCGTCTCCATT |
| 4957 | SPAC6F6.12_DN | CCGGGGGCAATTGGAGGGTA |
| 4958 | SPAC6F6.13c_UP | CAGGCGCCAAAGCAGATT |
| 4959 | SPAC6F6.13c_DN | GTCATCACGGGCACAGGGG |
| 4960 | SPAC6F6.15_UP | TCGGGAGGGGGTAAAGGGTG |
| 4961 | SPAC6F6.15_DN | TACAAATGGGGAGGACGGAC |
| 4962 | SPAC6F6.16a_UP | GCGAAGTAGCGGAGGGGACC |
| 4963 | SPAC6F6.16c_DN | GCCTGTCTCGGGTCTGCTCG |
| 4964 | SPAC6F6.18c_UP | TTCCGAGAAGTCCGTGACGC |
| 4965 | SPAC6F6.18c_DN | ACTGCGTCGTCAGGAGCGT |
| 4966 | SPAC6G10.02c_UP | CGGATACGTCCCCCAACAGG |
| 4967 | SPAC6G10.02c_DN | ACCCACCCACATCGTTCACCG |
| 4968 | SPAC6G10.03c_UP | ACTAAGGGCGGGGAGAACG |
| 4969 | SPAC6G10.03c_DN | TGAGCGCAGGGTGAATCCAA |
| 4970 | SPAC6G10.05c_UP | CACGGACCCACATTCCCCCC |
| 4971 | SPAC6G10.05c_DN | TGAACAGTGGGCAGACCCGT |
| 4972 | SPAC6G10.06_UP | TTCACCCGTTCCGGACTCCGT |
| 4973 | SPAC6G10.06_DN | TCCGGGGCGCCTAATCCATA |
| 4974 | SPAC6G10.07_UP | AGTGGCAAGATGAGCGGCCG |
| 4975 | SPAC6G10.07_DN | GCGGKGCGACGTATTAATGA |
| 4976 | SPAC6G10.08_UP | AGAGGAGGGAAAAGCACCG |
| 4977 | SPAC6G10.08_DN | CCATGCTGTTCGCGCCCATA |
| 4978 | SPAC6G10.09_UP | CGGCCCCCTATAAACGTCG |
| 4979 | SPAC6G10.09_DN | CCGCCTATTGTCGCCCTTGT |
| 4980 | SPAC6G10.10c_UP | CTCCCACACTTGCCGCTACG |
| 4981 | SPAC6G10.10c_DN | GGGACTGGGCTACCAACGGA |
| 4982 | SPAC6G10.11c_UP | GAGGGAGAGTAGGCAGCGGCA |
| 4983 | SPAC6G10.11c_DN | AACACGCTCCCCAATCCAC |
| 4984 | SPAC6G10.12c_UP | AGCGGCCTATCGGCTGTGTC |
| 4985 | SPAC6G10.12c_DN | GCCGATTGGCAGGAGCGCTA |
| 4986 | SPAC6G9.01c_UP | GACCCTCATGCAAGACCGCC |
| 4987 | SPAC6G9.01c_DN | TTGGCGCAAAACAGAACCGC |
| 4988 | SPAC6G9.02c_UP | AGGACACGCGATCCCAGGTT |
| 4989 | SPAC6G9.02c_DN | CCTAGTGGGCAGTGCAGCAA |
| 4990 | SPAC6G9.03c_UP | CAAGGAAAAGACCGGCCATC |
| 4991 | SPAC6G9.03c_DN | GTCACCTACAACCGCGCACG |
| 4992 | SPAC6G9.04_UP | GCCGCCACCACAGGAACAAG |
| 4993 | SPAC6G9.04_DN | TTAACTCCAGCCACGTGCCG |
| 4994 | SPAC6G9.05_UP | TCACCACCGCCCATCGAGAA |
| 4995 | SPAC6G9.05_DN | TGCCTAGGGGTCCAATGCCG |
| 4996 | SPAC6G9.06c_UP | AGCGGGGATTTTGCGCATGCA |
| 4997 | SPAC6G9.06c_DN | GGCCGGCACCCTTACCAACA |
| 4998 | SPAC6G9.07c_UP | AACCCGTCCAAGCCATCATG |
| 4999 | SPAC6G9.07c_DN | CAGGACAGAGCTCGAGGGGG |
| 5000 | SPAC6G9.08_UP | TCGGGGATTTTGGCGGTCAC |
| 5001 | SPAC6G9.08_DN | AAGTGGGTCATCGGCGCAAC |
| 5002 | SPAC6G9.09c_UP | ATGTTGATGTGCGGACGGGG |
| 5003 | SPAC6G9.09c_DN | ACGAGCCCCGCAAACAACTG |
| 5004 | SPAC6G9.10c_UP | TCGGTTTCCGGGCGTCTTAT |
| 5005 | SPAC6G9.10c_DN | GGCAAAAGCAAGGGGCGTTC |
| 5006 | SPAC6G9.12_UP | CGGGGGTGGCCATAGCAAAA |
| 5007 | SPAC6G9.12_DN | TGCCGGCTTCGCTCCCTGTA |
| 5008 | SPAC6G9.13c_UP | CCGGTGGTGCTCGTCTGGGT |
| 5009 | SPAC6G9.13c_DN | GTGGTTGGGCGGCTGTGGAG |
| 5010 | SPAC6G9.14_UP | TCTTTGTCGGGACCGCACTG |
| 5011 | SPAC6G9.14_DN | ATCCTCCCGGCCGGTTACAT |
| 5012 | SPAC6G9.15c_UP | CATCGCAAGGCCGTCAAAAG |
| 5013 | SPAC6G9.15c_DN | AGCTGCGATCGGGACCTTCC |
| 5014 | SPAC6G9.16c_UP | ATATGCTTCGCGAGCGGGTC |
| 5015 | SPAC6G9.16c_DN | TCTCAGCGTGTGCTGACGGA |
| 5016 | SPAC732.01_UP | TCATCCTTGCCATCGCTTTGC |
| 5017 | SPAC732.01_DN | CGTCCCGCCCAGTCAAAACA |
| 5018 | SPAC732.02c_UP | ACCATGACCTGAGCGAGCTG |
| 5019 | SPAC732.02c_DN | CTGTCCTCGTCCCAAGTCTC |
| 5020 | SPAC750.02c_UP | CCGTCCGTTGGTCTTTGCGT |
| 5021 | SPAC750.02c_DN | GGGGGCTGAGTTGCGATTTG |
| 5022 | SPAC750.03c_UP | TCAGAAACAACGCGCGGGAC |
| 5023 | SPAC750.03c_DN | TCAACAAAAGCCGCGGATCCG |
| 5024 | SPAC750.04c_UP | CAAGCCAGCCGCCGTACGAC |
| 5025 | SPAC750.04c_DN | AACAGCACACCACGGCGCAG |
| 5026 | SPAC750.05c_UP | GACAGGCTCGGCACTACCTT |
| 5027 | SPAC750.05c_DN | GTCGCAAACACCACCCCCTT |
| 5028 | SPAC750.06c_UP | CACGCCGACCCATGCTACTG |
| 5029 | SPAC750.06c_DN | GATTGGATGCGGGTACGGGA |
| 5030 | SPAC750.07c_UP | AATATGCGCGCACCAACCA |
| 5031 | SPAC750.07c_DN | AGACGCGGCCCACATAGCAA |
| 5032 | SPAC7D4.02c_UP | GCGGCACTCGGTTTAGGCG |
| 5033 | SPAC7D4.02c_DN | TGCTTTGGACCCGTATGGC |
| 5034 | SPAC7D4.03c_UP | GGGAGGTTGACGGTGGGCAT |
| 5035 | SPAC7D4.03c_DN | ACCCAATGGCGAACGGCTAG |
| 5036 | SPAC7D4.04_UP | TCGGCCGCAAAGTACCCAAA |
| 5037 | SPAC7D4.04_DN | TTCCCGGTCACCTGCAGTCA |
| 5038 | SPAC7D4.05_UP | TGGGGCTCGTGTCCGTTTCT |
| 5039 | SPAC7D4.05_DN | CCACACCCAACGCTACGCAA |
| 5040 | SPAC7D4.06c_UP | CCATGTTGAGGGGTCGAGGT |
| 5041 | SPAC7D4.06c_DN | TTGAGGGTTAAGCGGAGGCG |
| 5042 | SPAC7D4.37c_UP | ACCTGTTCCTCGTGCGCCCT |
| 5043 | SPAC7D4.07c_DN | GCGAGCCAAATCATGACGGG |
| 5044 | SPAC7D4.08_UP | CCCCAGAGCGTGATGCAACA |
| 5045 | SPAC7D4.08_DN | ACTTTGGGTCTGGGGTGCAC |
| 5046 | SPAC7D4.09c_UP | GGCGGGATGGTTAGGGGCAC |
| 5047 | SPAC7D4.09c_DN | CGAACCTCGGCTCCGCCTTCC |
| 5048 | SPAC7D4.10_UP | AGAATCCACGGCTCCCCACA |
| 5049 | SPAC7D4.10_DN | CCTCAGACTCCCGCTTGCCA |
| 5050 | SPAC7D4.12c_UP | CAGACACGCTTCCGGCAGCC |
| 5051 | SPAC7D4.12c_DN | CTCGACGCCGCCTCTTACGG |
| 5052 | SPAC7D4.13c_UP | GGGGGCGATGAAATGGTGT |
| 5053 | SPAC7D4.13c_DN | AGCAGCAAACGCACCCAAGA |
| 5054 | SPAC7D4.14c_UP | CATTCCCCCGTCAGTCCAT |
| 5055 | SPAC7D4.14c_DN | TCTCTTCAGTTTGGCCGGCA |
| 5056 | SPAC7D4.15c_UP | ACTGCCGACGAGCCGATACA |
| 5057 | SPAC7D4.15c_DN | GCGGTACCCGGATTCCGTT |
| 5058 | SPAC906.02c_UP | TTGACAGGCGCACGGGAGTA |
| 5059 | SPAC906.02c_DN | CTTAACGATTGGACCGCGCG |
| 5060 | SPAC906.03c_UP | TGGGGGTGAGAGTTGGCCGA |
| 5061 | SPAC906.03c_DN | CCGCCTGCCCTTTGTTTCAC |
| 5062 | SPAC906.04c_UP | AATTGCCACCCCATCGAACG |
| 5063 | SPAC906.04c_DN | GCTCCCTCCAACGTCCGAAC |
| 5064 | SPAC906.05_UP | GGGGGGTAGGAATTGCCGGG |
| 5065 | SPAC906.05_DN | CGAAGAAGATGACCCCCCGC |
| 5066 | SPAC906.07_UP | ACCCGCCGAACGCTACCCTC |
| 5067 | SPAC906.07_DN | GCCCCCGCAAATTCCATACG |
| 5068 | SPAC906.08c_UP | CCCCGGAGAACACTGCATCA |
| 5069 | SPAC906.08c_DN | GGGGCTGGTGACCTAGCTCG |
| 5070 | SPAC821.03c_UP | GCTTGATCGGCCCACGTTA |
| 5071 | SPAC821.03c_DN | GAAGCGTTGTCCCGGGGTCTG |
| 5072 | SPAC821.04c_UP | ACCCCTGCCCAAGTCAAACG |
| 5073 | SPAC821.04c_DN | GTGATTCGTCGCCGTGCTTC |
| 5074 | SPAC821.05_UP | TTATGTCGGGTGGCGAGGC |
| 5075 | SPAC821.05_DN | ATGGCTGGGGTTACGATGGG |
| 5076 | SPAC821.06_UP | AATCCACAGCCCCGATGAGC |
| 5077 | SPAC821.06_DN | TGGCCGATAGAAAGTCCCGC |
| 5078 | SPAC821.07c_UP | GTCGACATGACCGGGTGCCT |
| 5079 | SPAC821.07c_DN | AATCGTCAAATGGTCCCGGC |
| 5080 | SPAC821.08c_UP | ATGATCCCGGCCTTTCCGAC |
| 5081 | SPAC821.08c_DN | TGCTCGGGGTGCGTATCAGG |
| 5082 | SPAC821.09_UP | TAGCCCCATTCCCACCCCGA |
| 5083 | SPAC821.09_DN | TCCACATACACCTGCGGGTC |
| 5084 | SPAC821.10c_UP | CTCTTGCGTTGGTCCCCTGG |
| 5085 | SPAC821.10c_DN | AAGCGCGGCAAACTAGGGAC |
| 5086 | SPAC821.11_UP | GACCCGGACGCTCAACCATG |
| 5087 | SPAC821.11_DN | TTGAATTCGCGTGGTGGGGC |
| 5088 | SPAC821.12_UP | GTCGCAAATGGGCCGCTGAC |
| 5089 | SPAC821.12_DN | GACCAAGGCCTCGGGGAAAG |
| 5090 | SPAC828.02_UP | CTAAACCGCCGACTCACCGA |
| 5091 | SPAC828.02_DN | CTCCCAAAAGCCCCAGGTCG |
| 5092 | SPAC823.03_UP | ACCACGCCTCCCCCTTTTTG |
| 5093 | SPAC823.03_DN | GTGTGTACTGGATGCGCGGA |
| 5094 | SPAC823.04_UP | GCGGGACGAACAACGGCCAA |
| 5095 | SPAC823.04_DN | CAACAAGGCCGGAGGCAGCAA |
| 5096 | SPAC823.05c_UP | TTCCAAGCCAATCGATCCGG |
| 5097 | SPAC823.05c_DN | GTAGTGGCGGGGAGGGTGC |
| 5098 | SPAC823.06_UP | CAGCACCCCACCGTTTAGGC |
| 5099 | SPAC823.06_DN | TTGGTGATGAAACGGCGCGA |
| 5100 | SPAC823.07_UP | GAAGGGGGGCCAATCAGGT |

FIG.32

| Sequence number | Name | Base sequence | Sequence number | Name | Base sequence |
|---|---|---|---|---|---|
| 5101 | SPAC823.07_DN | GCGCGAATTGGGGTCGTAATG | 5203 | SPAC8E11.10_DN | CGGCTCAACAATTCACCGCA |
| 5102 | SPAC823.08c_UP | TCGTCTGCTTTTACCCCGCC | 5204 | SPAC8F11.02c_UP | GGGGCAGGCGCATGAAATAC |
| 5103 | SPAC823.08c_DN | GCAATGGGCAACACCCGTACG | 5205 | SPAC8F11.02c_DN | GCGGCAAGGCAGTACGTCAA |
| 5104 | SPAC823.09c_UP | AAAGCATTCAGCAGCGGGCG | 5206 | SPAC8F11.03_UP | AAGACCACACCCCGAGCAA |
| 5105 | SPAC823.09c_DN | CCCTGTCCCCTGTTTCTGCG | 5207 | SPAC8F11.03_DN | ACGGAAAGCGGGCAAAGACA |
| 5106 | SPAC823.10c_UP | GTCCGGGCCTGTTTTGGGT | 5208 | SPAC8F11.04_UP | TAGCAGCAGGTAGGCGGGGG |
| 5107 | SPAC823.10c_DN | CTATTTTTGGCACCGGCGCC | 5209 | SPAC8F11.04_DN | ACTGATGCGTGGTGGTTGCG |
| 5108 | SPAC823.11_UP | ACCTTCGCGGGCGTTTCTT | 5210 | SPAC8F11.05c_UP | TTTCGCACGTGCGTACCGTT |
| 5109 | SPAC823.11_DN | TTGCCGCGCCCTAAAATGCA | 5211 | SPAC8F11.05c_DN | CAGTGAGGGACCGAGCCGTT |
| 5110 | SPAC823.13c_UP | CTCACTCCAGCCGCAATCGG | 5212 | SPAC8F11.07c_UP | CGGCGCCATCAGAACCCATT |
| 5111 | SPAC823.13c_DN | TCGGGCGCATTTGGAACAGA | 5213 | SPAC8F11.07c_DN | CCTTTAACGCACGCGCCCAG |
| 5112 | SPAC823.14_UP | GGCATACCCCGTCCGCCTAG | 5214 | SPAC8F11.08c_UP | CGGACCTATCCGAGCCACAA |
| 5113 | SPAC823.14_DN | TCGATGGTCGGCTGAGGTGG | 5215 | SPAC8F11.08c_DN | AAACTCACGTGGTCGCCAGC |
| 5114 | SPAC823.15_UP | CCCATTCGAAAAACAGCCCG | 5216 | SPAC8F11.09c_UP | CCTTTCTGCTTTGGGGCCCC |
| 5115 | SPAC823.15_DN | CGTCCCCATAAAGCCACAA | 5217 | SPAC8F11.09c_DN | TCTTGGAGGCCCGATGCTGT |
| 5116 | SPAC823.16c_UP | TACGCGCCACGTGCGTAAA | 5218 | SPAC9.02c_UP | GGGTGCGGTTTGCTATTTGC |
| 5117 | SPAC823.16c_DN | AACATGTACGGGCGTGGGT | 5219 | SPAC9.02c_DN | GCCTCCAAGCTACTCCCGGG |
| 5118 | SPAC824.02_UP | ACATCCCGCCTACGTTTGCG | 5220 | SPAC9.03c_UP | TTTGGGAAGCGTTGGCAGGA |
| 5119 | SPAC824.02_DN | GTCGGCGATTGGCGGATTT | 5221 | SPAC9.03c_DN | GCAGCGGAGGTCAAAGAGGC |
| 5120 | SPAC824.03c_UP | TGCGTGGGGAGGCCTGTACT | 5222 | SPAC9.04_UP | AGCGAGAACGAATAGGCGGG |
| 5121 | SPAC824.03c_DN | GGACACCACGGCACTCGAGC | 5223 | SPAC9.04_DN | CATATGCAGAGCGGACGCCC |
| 5122 | SPAC824.04_UP | CAGCCCACATATCGCGGAAA | 5224 | SPAC9.05_UP | CCATTGTTTTGGCCGGCCTCC |
| 5123 | SPAC824.04_DN | GCATAAGCCGCAAATCCCCA | 5225 | SPAC9.05_DN | CAGCGGGAAGCGAGTGGACT |
| 5124 | SPAC824.05_UP | CCCGGCGCAATCAAAGACT | 5226 | SPAC9.06c_UP | CCTCGGGCGGAAGAATTGAA |
| 5125 | SPAC824.05_DN | ACCAAAAGCGCAACGCAACG | 5227 | SPAC9.06c_DN | GGTCTTTTTGCCAATCCGCG |
| 5126 | SPAC824.06_UP | TCCCGCCTTAGGCGTTGCCAC | 5228 | SPAC9.07c_UP | GTTGCATGTGCCTGTCGGCA |
| 5127 | SPAC824.08_DN | CTTGACCGACGCTCCGCCTA | 5229 | SPAC9.07c_DN | TGGTGGTCAGGCCGCAGTAA |
| 5128 | SPAC824.09c_UP | CATGTCGCGGCAACTTGGAA | 5230 | SPAC9.08c_UP | AGCCGCCACTAGTCCACGCA |
| 5129 | SPAC824.09c_DN | AAAACATGTCGCACTCGCCG | 5231 | SPAC9.08c_DN | TCGGGGCAGGACATGTGGAG |
| 5130 | SPAC869.01_UP | TTATGACGGCGGAAGGGCAG | 5232 | SPAC9.10_UP | CCCGACCCACAACACGACAA |
| 5131 | SPAC869.01_DN | CGCCACCACCGACACAAATG | 5233 | SPAC9.10_DN | GAAGCCAGCAAAGCAGCCGT |
| 5132 | SPAC869.02c_UP | CAGGACGGGCCAAAGAAGGG | 5234 | SPAC9.11_UP | GGCGTGTTTGAGGGGTTCGA |
| 5133 | SPAC869.02c_DN | CAAAATCTCTATGCGCCGCG | 5235 | SPAC9.11_DN | TGCTGCCCCGAATCCTTCT |
| 5134 | SPAC869.03c_UP | AAAGCCCCTACCCCCGCTAC | 5236 | SPAC9.12c_UP | AGCTGTTTCGCCCGCATCTC |
| 5135 | SPAC869.03c_DN | GCGTGAGGGATGTGGTCGGA | 5237 | SPAC9.12c_DN | GGGGGCCATGACGGTACGGT |
| 5136 | SPAC869.04_UP | TTGGTGTCGCGCGGAATTGA | 5238 | SPAC922.03_UP | CGCCCGTTGCCGGGTTCATTT |
| 5137 | SPAC869.04_DN | AAAAGGCTTGTCAGGGGTGC | 5239 | SPAC922.03_DN | CTCGGGCCTCACAAATTGCC |
| 5138 | SPAC869.05c_UP | GGAGGGTGCCGTGGTGGTTC | 5240 | SPAC922.04_UP | TCGATGAGAGGGAGCGTGGA |
| 5139 | SPAC869.05c_DN | CTGGAGTCGACGTGCCATGA | 5241 | SPAC922.04_DN | CATGCCCAACCGCCCCTTA |
| 5140 | SPAC869.06c_UP | CCCTGCGTCTCTCCCCCTGC | 5242 | SPAC922.05c_UP | TTCACTATACCGGCAGCAGC |
| 5141 | SPAC869.06c_DN | TCGAATCCCAAACCCGCTGT | 5243 | SPAC922.05c_DN | CCAGGGCGAAACGATGACGG |
| 5142 | SPAC869.07c_UP | ACTCGCGTGAGTGCGCTAAC | 5244 | SPAC922.06_UP | AGTGTAAGAGTGGCCCCTTCG |
| 5143 | SPAC869.07c_DN | TTCAATTGTGTGGCCCGTGC | 5245 | SPAC922.06_DN | GCGACTGTCATGTGGCAGGA |
| 5144 | SPAC869.08_UP | TTTTGACGGGGGGCTTTTG | 5246 | SPAC922.07c_UP | GCGCCCGACCCTTAAGAACC |
| 5145 | SPAC869.08_DN | TCGGTCATCGTGGCTGGAGGG | 5247 | SPAC922.07c_DN | GTGTGCTGAGTGGCGGGTCG |
| 5146 | SPAC869.09_UP | CGGCGCTGGGTGTACGACGG | 5248 | SPAC926.02_UP | AGCCACACCGCGTCCCTATTT |
| 5147 | SPAC869.09_DN | TGGAGAAGAGGGCGCGAAGA | 5249 | SPAC926.02_DN | TGAGTGCGGGTGTAACTGCGG |
| 5148 | SPAC869.10c_UP | GGTAGCGGGGATGGAGGTT | 5250 | SPAC926.03_UP | GATGGGGAACGAGGGAGGCG |
| 5149 | SPAC869.10c_DN | ATGTGCCCCCGCCCCAAAAA | 5251 | SPAC926.03_DN | ACGGCACCTTCTCTCACCGC |
| 5150 | SPAC890.02c_UP | CTCATCACGCCTCCGCCTA | 5252 | SPAC926.04c_UP | GCAACAGGGGAGCCAAGAA |
| 5151 | SPAC890.02c_DN | TCTTCGTTGCCGCGCCTGCTT | 5253 | SPAC926.04c_DN | GTCTGGCGGCTTGCTTTGC |
| 5152 | SPAC890.03_UP | TAGTGCAAAAATCGCGGCG | 5254 | SPAC926.05c_UP | CCACAAAGATGCAGCCCGAA |
| 5153 | SPAC890.03_DN | AATCGTCACAGCGTGGGCAA | 5255 | SPAC926.05c_DN | TGTCGGTGCGTATTGGGGGA |
| 5154 | SPAC890.04c_UP | GCGTTCTTAGGCCCCGGTGT | 5256 | SPAC926.06c_UP | CCCTCGCCACCTGCTTCATT |
| 5155 | SPAC890.04c_DN | TCGATTTTTCCCGGCCCATG | 5257 | SPAC926.06c_DN | TGGTTTGTGACCATTCGGCC |
| 5156 | SPAC890.05_UP | ACCGCACCAGCATTCACACA | 5258 | SPAC926.07c_UP | TGCGGGCAGAAGTTATGGGG |
| 5157 | SPAC890.05_DN | GCCTCGGCTCGACAATGCCAA | 5259 | SPAC926.07c_DN | GGGGCTAATTCGTCACGGGG |
| 5158 | SPAC890.06_UP | ATTGCGGAGGGGAGGCTTA | 5260 | SPAC926.08c_UP | ACTGAGCCGGTCGCAACATA |
| 5159 | SPAC890.06_DN | TCGTCGCGCTCAAATGCCAC | 5261 | SPAC926.08c_DN | CCCGGGAACCAAAGCACCTA |
| 5160 | SPAC890.07c_UP | TCGCGGACTATAGCGCTCGT | 5262 | SPAC926.09c_UP | ACCCCATGGTACGCAGACCT |
| 5161 | SPAC890.07c_DN | ATGGGCCGGATAGCGTAAC | 5263 | SPAC926.09c_DN | GGTAACTACGGGCGCTGAGA |
| 5162 | SPAC890.08_UP | ACGGACGTCACGTTAGGCAT | 5264 | SPAC959.03c_UP | ACCAACACGGGGAGAGGGT |
| 5163 | SPAC890.08_DN | CAACGTCTCACGCTGCATGG | 5265 | SPAC959.03c_DN | CTCGCCCGTGATGGAATTCG |
| 5164 | SPAC8C9.04_UP | GCGAGCTGGGACGGTTGGTT | 5266 | SPAC959.04c_UP | TGTTGGCCGTGTTGTGCAGG |
| 5165 | SPAC8C9.04_DN | ACGCAAGAGAACGGGACGCC | 5267 | SPAC959.04c_DN | TACACGCCACCGACCCCATC |
| 5166 | SPAC8C9.05_UP | GGCTTTGACGTCCTTTGCCG | 5268 | SPAC959.05c_UP | TCAGCGAGGACCGGCATCAA |
| 5167 | SPAC8C9.05_DN | TGGCTTTACACGCGTGGAG | 5269 | SPAC959.05c_DN | ACACGGTGACCAGCGAAGAC |
| 5168 | SPAC8C9.06c_UP | TGTGACGCAAAATCCGGACG | 5270 | SPAC959.06c_UP | AGCAGGCAGTCAGCGCAGTC |
| 5169 | SPAC8C9.06c_DN | AGGGGGTGTGGGGCTGTCAT | 5271 | SPAC959.06c_DN | CGTCGGGCTTCTTACTGGTG |
| 5170 | SPAC8C9.07_UP | TGCCCTGATTACCCAACCCG | 5272 | SPAC959.07_UP | AGGTGGGAAATCGGGCCAAC |
| 5171 | SPAC8C9.07_DN | CCCGCTGTCCGTTTCTTGG | 5273 | SPAC959.07_DN | GGGGCAAAGGAGTGAGGGGG |
| 5172 | SPAC8C9.08_UP | CGGGGGCAGGAGACCAAC | 5274 | SPAC959.08_UP | GGCGTGAGCGTCGTGATGAA |
| 5173 | SPAC8C9.08_DN | AAGAACCCTGCAAAGCCCGC | 5275 | SPAC959.08_DN | TCCCAGCCATTCCCGCTTC |
| 5174 | SPAC8C9.09c_UP | CGGTGTCATAATCGGGGCGT | 5276 | SPAC959.10_UP | TTGAGGTCCCGAGAGGTGCT |
| 5175 | SPAC8C9.09c_DN | TCCACTCTACCCGCGTCCCCG | 5277 | SPAC959.10_DN | TGACCGGCGTTAGTCGCTCA |
| 5176 | SPAC8C9.10c_UP | GGTCGGCCGTGATTGAGGTG | 5278 | SPAC977.01_UP | CTAGCTTGCCCCCCCGAAA |
| 5177 | SPAC8C9.10c_DN | GGCCTCTTGACGTCCTTTGTGC | 5279 | SPAC977.01_DN | GACTGATCCTGCCCAGCGAT |
| 5178 | SPAC8C9.11_UP | ACGAGTAGGCGCCCAGCAAT | 5280 | SPAC977.02_UP | CCAACCACAGGCACCCAAGC |
| 5179 | SPAC8C9.11_DN | GACGTGTATGGGCAGCCCGA | 5281 | SPAC977.02_DN | GCTTCGCTCCTCACTCGG |
| 5180 | SPAC8C9.12c_UP | TTCTCCCATTGCTGTGCCCC | 5282 | SPAC977.03_UP | GGCTGCGGCTTGGGAGTACA |
| 5181 | SPAC8C9.12c_DN | TCTGGGCGGAGATGCAATTG | 5283 | SPAC977.03_DN | ACCGCCGTCCACCTCATCGA |
| 5182 | SPAC8C9.14_UP | TGAGGACGGGCAGGAGCGAG | 5284 | SPAC977.06_UP | AAGGGCGCGCATATTCTGAG |
| 5183 | SPAC8C9.14_DN | GGGCCGGGTATACTGGGTCA | 5285 | SPAC977.06_DN | GGCCAACAACCGTCGGCTAT |
| 5184 | SPAC8C9.15c_UP | CACGACGCAGCCAAAGAACC | 5286 | SPAC977.08_UP | AGCGGGCCGTTGCAAAATACA |
| 5185 | SPAC8C9.15c_DN | TCGGAGGGCGAATTCCGTAC | 5287 | SPAC977.08_DN | TAAACCCCCCGGCCACGAGTA |
| 5186 | SPAC8C9.16c_UP | GGAAGTGCGGTCAGCAAC | 5288 | SPAC977.09c_UP | ATCCATTAACTCCCCGCCGT |
| 5187 | SPAC8C9.16c_DN | CGCCGAAAGCCACGTATGCC | 5289 | SPAC977.09c_DN | AGCGTGTGAGGGGTGCGTGG |
| 5188 | SPAC8C9.17c_UP | AGGGCGATCCTCCCGCGTTC | 5290 | SPAC977.10_UP | TCACCGATCCCCTGCCACTC |
| 5189 | SPAC8C9.17c_DN | TGCTGGCCGGGTTGTAGGTG | 5291 | SPAC977.10_DN | AAGGATTGAAACGGGTGGCG |
| 5190 | SPAC8C9.19_UP | ACTTCCGCTACACCAGGGA | 5292 | SPAC977.11_UP | ACCGCCATGCCCTTCCGTAG |
| 5191 | SPAC8C9.19_DN | TTCCTCGGTCACTCGGCACA | 5293 | SPAC977.11_DN | CGCTGCTCCCGTTGTTCTCA |
| 5192 | SPAC8E11.02c_UP | GAAGGCCGGGAGATGCATA | 5294 | SPAC977.12_UP | CTTCACCCACCGCCCTGTTT |
| 5193 | SPAC8E11.02c_DN | TCTTTTCCGGTCGTCAGGCG | 5295 | SPAC977.12_DN | AAGGTCGCCCGTCTCAACGAT |
| 5194 | SPAC8E11.03c_UP | TGCCAATCCCTTCCCCAGCG | 5296 | SPAC977.13c_UP | GACAGCGGCACACAAGGGT |
| 5195 | SPAC8E11.03c_DN | TGCTGGTAATGGAAGACGCGG | 5297 | SPAC977.13c_DN | TGATGTGCCCGTGGTTTGG |
| 5196 | SPAC8E11.05c_UP | GAATGGCTAAACGGTCGGG | 5298 | SPAC977.14c_UP | GCGCCACAACCACCTTGCAC |
| 5197 | SPAC8E11.05c_DN | TCGCTACCCGAACCCTTGCCA | 5299 | SPAC977.14c_DN | GATCCAGTCGCACGCAAAGC |
| 5198 | SPAC8E11.06_UP | GTTGCGGCGTTGCGTAGTTC | 5300 | SPAC977.15_UP | TGGTGGAGATTGAGGCCGGC |
| 5199 | SPAC8E11.06_DN | TTGAAAACTCCGCCCATCCC | 5301 | SPAC977.15_DN | GTAGCCAGGCATGGCAGGT |
| 5200 | SPAC8E11.07c_UP | CCCGAGCCGCGCCTCTGATGA | 5302 | SPAC977.16c_UP | TGGATGGGCGGAGAGTCGGT |
| 5201 | SPAC8E11.07c_DN | ACTTGGCCGCCTCTCTCTCC | 5303 | SPAC977.16c_DN | GAACACGGCCCTGCAAATT |
| 5202 | SPAC8E11.10_UP | AGCTTCGATGGCGGTGGTTG | 5304 | SPAC977.17_UP | CTCGCACCCCATCACCCAGC |

FIG.33

| Sequence number | Name | Base sequence |
|---|---|---|
| 5305 | SPAC977.17_DN | AGGGGAGGGAGCGGCGGTAT |
| 5306 | SPAC9E9.03_UP | GTAGACATCGCGCCCAACG |
| 5307 | SPAC9E9.03_DN | GAGGGATAGCGAAACCCCCC |
| 5308 | SPAC9E9.04_UP | GTGGGGCTCCGGTTTCAAGA |
| 5309 | SPAC9E9.04_DN | AGCAGAACAACGGGGAACGT |
| 5310 | SPAC9E9.05_UP | TCGGCCTCATGTCGCTTTTT |
| 5311 | SPAC9E9.06_DN | GGCTCTTCGCTGCACTCCCG |
| 5312 | SPAC9E9.08_UP | CGCCCTGTGCAGACGCTAAC |
| 5313 | SPAC9E9.08_DN | CATGCGAGCAGGGGTCAAGA |
| 5314 | SPAC9E9.09c_UP | TTGCGCATTGTTCGGACGCG |
| 5315 | SPAC9E9.09c_DN | ATTCGCATGGACGTAGGGG |
| 5316 | SPAC9E9.10c_UP | GGGGTTCGCTCGCGGTGTAC |
| 5317 | SPAC9E9.10c_DN | GGTGCGGGTTGGGAATGGTC |
| 5318 | SPAC9E9.12c_UP | CGCCGACCTTCGCIACCCACG |
| 5319 | SPAC9E9.12c_DN | TGCGGGAGATGGGGTCAGAG |
| 5320 | SPAC9E9.13_UP | CCTCGTTCTTCCCAAGGCCG |
| 5321 | SPAC9E9.13_DN | CTAAAGTCGGCTCTCGCGCG |
| 5322 | SPAC9E9.14_UP | GCGAGCAACAAGCCGACCAA |
| 5323 | SPAC9E9.14_DN | TGAACGTCGATAGCGGGCGG |
| 5324 | SPAC9E9.15_UP | AGAAACACCCGCGCCACCTC |
| 5325 | SPAC9E9.15_DN | CAGGGTAGCGAGGAGAGCGG |
| 5326 | SPAC9E9.17c_UP | GCCCCTCGGTGCCAAGTAC |
| 5327 | SPAC9E9.17c_DN | CCACCACAATTTTCCGCCGT |
| 5328 | SPAC9G1.02_UP | TGAGGTCTATGGCGGGGCAG |
| 5329 | SPAC9G1.02_DN | TACTCCTCGCTCACCCCCGA |
| 5330 | SPAC9G1.03c_UP | TCCACCCAGTCTCCCGCCCT |
| 5331 | SPAC9G1.03c_DN | TACCCGCCCACGCGACAITA |
| 5332 | SPAC9G1.04_UP | ATTCGTTGAGCTTCGCCGGG |
| 5333 | SPAC9G1.04_DN | TAGGGCGGGAGTCGTCAAAG |
| 5334 | SPAC9G1.05_UP | ATAGTTGCGGGGACCTCGGA |
| 5335 | SPAC9G1.05_DN | ATCGTTGTCTTCCCGCCCTC |
| 5336 | SPAC9G1.06c_UP | TTGCATTTCCGCCCTGGTGA |
| 5337 | SPAC9G1.06c_DN | GTTCGCGACTTGATGAGCC |
| 5338 | SPAC9G1.07_UP | AAGCGTCCGTCCCCTGGTTA |
| 5339 | SPAC9G1.07_DN | AACTCATCCCCTCCCCCAC |
| 5340 | SPAC9G1.08c_UP | AGGGAAGCAGCCCCAGGTTTA |
| 5341 | SPAC9G1.08c_DN | CGGTTGCGCGGTTAATGAAA |
| 5342 | SPAC9G1.09_UP | CGGGTGGCTATTTCTGGCGC |
| 5343 | SPAC9G1.09_DN | TTCCGACGCTAATGGCCCCC |
| 5344 | SPAC9G1.10c_UP | AGGCGTCTCCGTTCGTGCA |
| 5345 | SPAC9G1.10c_DN | GCTTTAATCGCTGCCGCCTC |
| 5346 | SPAC9G1.11c_UP | GTGAGGGATAACGCCGGAA |
| 5347 | SPAC9G1.11c_DN | GAAATTTGCTTCGCGGGCCT |
| 5348 | SPAC9G1.12_UP | TTTCGGTTCGAGGTGCTGGC |
| 5349 | SPAC9G1.12_DN | GCGCACTCGCTCCATAACGA |
| 5350 | SPAC9G1.13c_UP | AGGCGGTTAGGGGGTGAGGA |
| 5351 | SPAC9G1.13c_DN | TCGCCCACGACTGACTGCAT |
| 5352 | SPACUNK12.02c_UP | TCCCCGGCTTTACCTCGCAA |
| 5353 | SPACUNK12.02c_DN | AGGGCCGGAACTGGTAGGGGC |
| 5354 | SPACUNK4.08_UP | GAAGCAACGGGAACAGCACG |
| 5355 | SPACUNK4.08_DN | TGGTCGCTTCGCTTCCCTTG |
| 5356 | SPACUNK4.09_UP | TTGGGCGGGAACAAGGAAGA |
| 5357 | SPACUNK4.09_DN | CCACCTTGTTTTGCGGACC |
| 5358 | SPACUNK4.10_UP | CGCCCTCCCAGCATGTCGTA |
| 5359 | SPACUNK4.10_DN | TCACAAGCCCGAAACCCTCCA |
| 5360 | SPACUNK4.11c_UP | ATGACGGCGAGAGGGGGAA |
| 5361 | SPACUNK4.11c_DN | TTGCACGGAGTCGACGCGCC |
| 5362 | SPACUNK4.12c_UP | CCTCGCCCTGGTTGTGTCCT |
| 5363 | SPACUNK4.12c_DN | GAGTTATGGGCGTCGGGTGC |
| 5364 | SPACUNK4.13c_UP | ACATCTTTGTCGTCCCTGCCG |
| 5365 | SPACUNK4.13c_DN | CCGCCAACCCGTGTACACC |
| 5366 | SPACUNK4.14_UP | GCACGGGATGGGGAAAATT |
| 5367 | SPACUNK4.14_DN | CGAGGGCACGAGGTTACGCA |
| 5368 | SPACUNK4.15_UP | GTGGGTGAGTCGGAAGGGG |
| 5369 | SPACUNK4.15_DN | TTTCCTAAGCTTCCGGGCCC |
| 5370 | SPACUNK4.16c_UP | GGGGCGGGGTCCTTGATACT |
| 5371 | SPACUNK4.16c_DN | CCGTCCTGCACCTGTTTCCG |
| 5372 | SPACUNK4.17_UP | TCACCACGCTCAACCGAAG |
| 5373 | SPACUNK4.17_DN | AGCGGTATTGCCTTGGGTGC |
| 5374 | SPAP11E10.02c_UP | TAAGTCCTCTCCCCCGCC |
| 5375 | SPAP11E10.02c_DN | GCAAACCGAACGCCCAGAAA |
| 5376 | SPAP14E8.02_UP | AGATCCGGCAACCCCGCTGT |
| 5377 | SPAP14E8.02_DN | CCCCACCGAGTACCATGTCA |
| 5378 | SPAP14E8.04_UP | CGCAAAGCCCCACGGTAAGA |
| 5379 | SPAP14E8.04_DN | TGCCGTGACGCTCGTGACTC |
| 5380 | SPAP14E8.05c_UP | GCCTTCAGCCGTCCCCATGC |
| 5381 | SPAP14E8.05c_DN | TACGGCTGGGGTTTGCAGG |
| 5382 | SPAP19A11.05c_UP | GTGGGGCATATTGCAGGCGA |
| 5383 | SPAP19A11.05c_DN | CGCGCCACCCTAACAACTGA |
| 5384 | SPAP27G11.02_UP | AGCGGCCCTGAGCAAGAAAA |
| 5385 | SPAP27G11.02_DN | TTTCGGAGGTGAGTGCGTGC |
| 5386 | SPAP27G11.06c_UP | GTGGGAGCGCGCGGATAATG |
| 5387 | SPAP27G11.06c_DN | CCTCGCACCTTCCGTCGTCC |
| 5388 | SPAP27G11.10c_UP | CCGGTTACGCCAGGACAAGT |
| 5389 | SPAP27G11.10c_DN | GAACGCGACCGTCCTCTCTT |
| 5390 | SPAP27G11.11c_UP | CGCGGGGTTTGCCTAGTGAC |
| 5391 | SPAP27G11.11c_DN | TCAGAACTCAGGCCCACCTC |
| 5392 | SPAP27G11.12_UP | CTTTCCGCCAAGCCATGTA |
| 5393 | SPAP27G11.12_DN | CAGGCGGATGGAGCGTTACC |
| 5394 | SPAP27G11.13c_UP | CCACGGGGAAAAAAAACCGG |
| 5395 | SPAP27G11.13c_DN | GGCGTTCAATCGTCGTCAT |
| 5396 | SPAP27G11.14c_UP | GAACCAATTGCCCATTCGCC |
| 5397 | SPAP27G11.14c_DN | TGGTCACGTGAATCGCGGCA |
| 5398 | SPAP27G11.15_UP | CCGTGCCAGTTCGTTCGTCG |
| 5399 | SPAP27G11.15_DN | CTTATCGCCCCTCAGACCCG |
| 5400 | SPAP27G11.16_UP | TCCTAGCTAGCGACCTGGCA |
| 5401 | SPAP27G11.16_DN | CGACACGCGGTCCGGAGAGAT |
| 5402 | SPAP32A8.02_UP | CTGGGGCCTGTGCGTACGTT |
| 5403 | SPAP32A8.02_DN | CCTCTCCCATTCCTCGCACG |
| 5404 | SPAP32A8.03c_UP | AATGGTAGGAGAGGGGCGCC |
| 5405 | SPAP32A8.03c_DN | TTTGTCCGGAGTGCGCATGC |
| 5406 | SPAP7G5.03_UP | ATCATGGGGTCCGGGCTTTG |
| 5407 | SPAP7G5.03_DN | TGTAATCCGCGCAAACGTCG |
| 5408 | SPAP7G5.04c_UP | CACGCCCCCCCTGAGATGT |
| 5409 | SPAP7G5.04c_DN | TGACCCCCGCACGAATGACC |
| 5410 | SPAP7G5.05_UP | CACGCGGATTCTGTCCACC |
| 5411 | SPAP7G5.05_DN | TCACTGACGCCGCCTTTCT |
| 5412 | SPAPBA3.02c_UP | CCCCCGCTTTCTTGCATCAC |
| 5413 | SPAPBA3.02c_DN | CCAAGCCACCCCTACGCCAG |
| 5414 | SPAPBA3.03_UP | CGTGTAAAAGGCGCGAACCA |
| 5415 | SPAPBA3.03_DN | GAGCGGTGGGGRCGAGGRAC |
| 5416 | SPAPBA3.04c_UP | CAAAACCGGAAGGCAACGC |
| 5417 | SPAPBA3.04c_DN | CGCCGGACCCATACCACAGT |
| 5418 | SPAPBA3.05_UP | TTTTTCCAACCGAASCCCGT |
| 5419 | SPAPBA3.05_DN | GCGGTCTTGGCICGCGTTGC |
| 5420 | SPAPBA3.07c_UP | CGGTTCACATGGGCGTTTC |
| 5421 | SPAPBA3.07c_DN | ACGTGCTCATGGCCTTTTT |
| 5422 | SPAPBA3.08_UP | GGATCGCCCCAGATGAGAC |
| 5423 | SPAPBA3.08_DN | TTATGTCAGAACAACCSCGG |
| 5424 | SPAPBA3.09c_UP | TTGTCCCGATAGCTCTGCCG |
| 5425 | SPAPBA3.09c_DN | ATGGGGCCTCTCGGATGTTG |
| 5426 | SPAPBA3.10_UP | GGTACCCCCTCTGCACAGCG |
| 5427 | SPAPBA3.10_DN | CCGCTTGATGTCCGCCTTTC |
| 5428 | SPAPBA3.11c_UP | GGCCTCAAACGCGCAGCATA |
| 5429 | SPAPBA3.11c_DN | GCCTGCCGATGCCCGTATAC |
| 5430 | SPAPBA3.12c_UP | CGGGTCATCAAAAGGGTGGC |
| 5431 | SPAPBA3.12c_DN | TCCGAAGTACCCCAAGCGGC |
| 5432 | SPAPBA3.13c_UP | CACAAACTCCCGATCTCCCG |
| 5433 | SPAPBA3.13c_DN | ASGGAAGCAGGATCGGGGAG |
| 5434 | SPAPBA3.14c_UP | GCGTAGGTGCGCGGACAGAG |
| 5435 | SPAPBA3.14c_DN | GCGCCCTCTTCGTGCTTGTT |
| 5436 | SPAPB15E9.03c_UP | CAGTTAGCTCCGTGCGAGGT |
| 5437 | SPAPB15E9.03c_DN | AACGCGTACTGACGGAGCGG |
| 5438 | SPAPB17E12.02_UP | AGGCTCACGTGCTCGTCACA |
| 5439 | SPAPB17E12.02_DN | CGATCGCCGCGTTATTCGCT |
| 5440 | SPAPB17E12.04c_UP | ATACCCTTACGCTGCACCG |
| 5441 | SPAPB17E12.04c_DN | TCAAGGACTGCTACCGTCGG |
| 5442 | SPAPB17E12.05_UP | ATCCGTGCGACGCTAAGCAG |
| 5443 | SPAPB17E12.05_DN | ATGGACGTCCGTGTGTTCCC |
| 5444 | SPAPB17E12.07c_UP | CGGGTCCTTACGTCGCATCT |
| 5445 | SPAPB17E12.07c_DN | CGACCGGAGTTACTCACGCA |
| 5446 | SPAPB17E12.08_UP | GGAGGTCACTATGCGGCCAA |
| 5447 | SPAPB17E12.08_DN | CATGCGAGGTTGACCGCTCT |
| 5448 | SPAPB17E12.09_UP | CACTTGTGGTACGGGCGGTT |
| 5449 | SPAPB17E12.09_DN | TAGGCGTGGCCTTAGCGAGA |
| 5450 | SPAPB17E12.10c_UP | ACTTCCGGCAATCACGTGGA |
| 5451 | SPAPB17E12.10c_DN | CGACGCCCTGCGCATACACA |
| 5452 | SPAPB17E12.11_UP | GAGCATCGTCCAGCCGATAT |
| 5453 | SPAPB17E12.11_DN | TTCATCCCGGACACGTCGCT |
| 5454 | SPAPB17E12.12c_UP | TTCACTCGACCGTGGCGACT |
| 5455 | SPAPB17E12.12c_DN | AACCGGTCGACTCCGGATGT |
| 5456 | SPAPB17E12.14c_UP | TCGAAAGCGACCCTAGGCGA |
| 5457 | SPAPB17E12.14c_DN | ATCTCTCTGCGCGACCACAA |
| 5458 | SPAPB18E9.01_UP | TGGACGGACAGATCAAGCC |
| 5459 | SPAPB18E9.01_DN | TACTCACCTGGGCGGACCAA |
| 5460 | SPAPB18E9.04c_UP | CTGTGAGCGCCAGTGTGAGT |
| 5461 | SPAPB18E9.04c_DN | TGTCGCGACCGCTAGCGAAA |
| 5462 | SPAPB1A10.02_UP | CGCCCACCAATTCGAGCTCT |
| 5463 | SPAPB1A10.02_DN | AAAGCGGGTGCTCAATCGGG |
| 5464 | SPAPB1A10.03_UP | CCCCAGGGTGCTACCCAGCC |
| 5465 | SPAPB1A10.03_DN | GCTACACGCGACATCACGCC |
| 5466 | SPAPB1A10.04c_UP | TGTGCGGGCTGCAGGATCTT |
| 5467 | SPAPB1A10.04c_DN | ACGGCAGCCGTAGAACGGTT |
| 5468 | SPAPB1A10.05_UP | ACCAASCTATCAGCCCCGCS |
| 5469 | SPAPB1A10.05_DN | GTTCCCCGTCTTTTGCCAGC |
| 5470 | SPAPB1A10.06c_UP | TACCCGTTCCTGGCTTCTGGC |
| 5471 | SPAPB1A10.06c_DN | CAACGGCCGGGACATCAAGA |
| 5472 | SPAPB1A10.07c_UP | GTGAACTGGGGGCGACTTGG |
| 5473 | SPAPB1A10.07c_DN | AAGCGATTACCCCTGCACGG |
| 5474 | SPAPB1A10.08_UP | CGGGCCAGCTGAAAAGAGGT |
| 5475 | SPAPB1A10.08_DN | CACTAAAATTTCCGCGCCCC |
| 5476 | SPAPB1A10.09_UP | TTTCGGTCACCCGAGTTGGT |
| 5477 | SPAPB1A10.09_DN | TGTGCCGCAGTACCTGGATT |
| 5478 | SPAPB1A10.10c_UP | ATCTCCAACGGGCGAACCTG |
| 5479 | SPAPB1A10.10c_DN | GCGGGCATGGTTCGATACAA |
| 5480 | SPAPB1A10.11c_UP | CGGATTCAGTCCACATGCGG |
| 5481 | SPAPB1A10.11c_DN | CTGCCGACGCTTCATGGACC |
| 5482 | SPAPB1A10.12c_UP | GGACCTCCCCGCTGGCATT |
| 5483 | SPAPB1A10.12c_DN | GGGACGAGCCATGACCGGGT |
| 5484 | SPAPB1A10.13_UP | TCCGAAAGGCCTGAAAGCCA |
| 5485 | SPAPB1A10.13_DN | ATTTTTGCCCGACACCTCCG |
| 5486 | SPAPB1A10.14_UP | CTCCCCTTGAAAATACGCCCG |
| 5487 | SPAPB1A10.14_DN | TCTGCGTTTCGGAGTGGCTT |
| 5488 | SPAPB1A10.15_UP | ACAAACACGCGGCAACATCG |
| 5489 | SPAPB1A10.15_DN | CTGTTTTTTGGCCGGGACGA |
| 5490 | SPAPB1A11.02_UP | ACGCGCAGACTCTCCCCCTC |
| 5491 | SPAPB1A11.02_DN | CATGAAAGGGGGCAGTCCA |
| 5492 | SPAPB1A11.03_UP | GGGGCACTGACTCCGGGATG |
| 5493 | SPAPB1A11.03_DN | TAGGGCGTGCGAAGGGAAAT |
| 5494 | SPAPB1A11.04c_UP | CCTGGCGCATGCTCCCAATA |
| 5495 | SPAPB1A11.04c_DN | GGGGCTGAGATGTAGGGCCA |
| 5496 | SPAPB1E7.01c_UP | ACCGCGATGCCACACCCCA |
| 5497 | SPAPB1E7.01c_DN | CGAACCCGCCACRACCCAGA |
| 5498 | SPAPB1E7.02c_UP | CTCGTGTGTTTGCGGCTGGC |
| 5499 | SPAPB1E7.02c_DN | TTGAGGACTTGGCACCGCGT |
| 5500 | SPAPB1E7.03_UP | CGCCCAGTACTCCCAACGCC |
| 5501 | SPAPB1E7.03_DN | TGACTTTGGCGCTGAGGGGG |
| 5502 | SPAPB1E7.04c_UP | TCGGGTCGTCGCGTTCTAGC |
| 5503 | SPAPB1E7.04c_DN | AGCGTTTCTGCGATGCGGTC |
| 5504 | SPAPB1E7.05_UP | TTCAAACGCGCGGGGACTG |
| 5505 | SPAPB1E7.05_DN | ACCCCGCCTCCTTCCTATGG |
| 5506 | SPAPB1E7.06c_UP | AAACCGCGAATTCGGCAGCCT |
| 5507 | SPAPB1E7.06c_DN | GCAGGGCACGGTTAGGGAAG |
| 5508 | SPAPB1E7.09c_UP | GCCTGAATCGACGTGCCTCA |

FIG. 34

| Sequence number | Name | Base sequence | Sequence number | Name | Base sequence |
|---|---|---|---|---|---|
| 5509 | SPAFB1E7.08c_DN | TCGAACTCCGCTGGGCGAGA | 5611 | SPBC1105.02c_DN | CCTCAACAATATGCCCCCCG |
| 5510 | SPAFB1E7.10_UP | TCCATCCAACCGCCGTCATA | 5612 | SPBC1105.03c_UP | AAGCCGCGGGATAAGAAGTG |
| 5511 | SPAFB1E7.10_DN | CACCTCCGAAAATCCCGCCT | 5613 | SPBC1105.03c_DN | GCAGCCGCCCAATAACCTCG |
| 5512 | SPAFB1E7.11c_UP | AAAATGGCGCGGACAATGCA | 5614 | SPBC1105.04c_UP | CGCGCCCGTTCATCGATGAT |
| 5513 | SPAFB1E7.11c_DN | AGATGGAGGGGCAGCAAGCA | 5615 | SPBC1105.04c_DN | CGGTGGTGCTCCTGTTCGTG |
| 5514 | SPAFB1E7.12_UP | ACCCTGCACAACGAGCCCCT | 5616 | SPBC1105.05_UP | TCAGCCCCGCCAGTGTTGTC |
| 5515 | SPAFB1E7.12_DN | CCCGAATCCGCGCATAAAGTT | 5617 | SPBC1105.05_DN | CGCCTTGAGTCACCACCCGT |
| 5516 | SPAFB21F2.02_UP | GACGGCGCGGAGCTGAGAAA | 5618 | SPBC1105.06_UP | TGATTCTTCTCCGCACCGAG |
| 5517 | SPAFB21F2.02_DN | GTCCGTTGGGCTGCGTGTCC | 5619 | SPBC1105.06_DN | ACCCAGTAGGCTAGAGCGGT |
| 5518 | SPAFB24D3.02c_UP | ACGACCTTACCCGCACCCAA | 5620 | SPBC1105.07c_UP | CCTTACGCCACCGCTCCCTA |
| 5519 | SPAFB24D3.02c_DN | ACTGGCTTCCCCGACTCCCG | 5621 | SPBC1105.07c_DN | TTATGTGGTTCGCGCCCGTC |
| 5520 | SPAFB24D3.03_UP | AGTGCTGGAAATGCGTGTCG | 5622 | SPBC1105.09_UP | AAGCACAGGGAAGACCCCGA |
| 5521 | SPAFB24D3.03_DN | TAGACCGGCACAAGGAGCCCG | 5623 | SPBC1105.09_DN | TTCGGAGGATTGGGCTGGAC |
| 5522 | SPAFB24D3.04c_UP | CTTCGGCGCACGCGATTGA | 5624 | SPBC1105.10_UP | TCAAGAGGCGCGGGATCACT |
| 5523 | SPAFB24D3.04c_DN | TTGGGGCCGACGATGATGAG | 5625 | SPBC1105.10_DN | CCCATTGGCCGGGTCGTTAA |
| 5524 | SPAFB24D3.06c_UP | GGGAGACCCCGCGAATGTA | 5626 | SPBC1105.11c_UP | CAGTCGGCAGGTGGTAGGCC |
| 5525 | SPAFB24D3.06c_DN | CTATGGTGGAACTCGGCGGG | 5627 | SPBC1105.11c_DN | TCGTTGCTGCATCCCTCGCG |
| 5526 | SPAFB24D3.07c_UP | CCAAACACGCTACCGACCCA | 5628 | SPBC1105.12_UP | CCGAATGAGCCCAAGGCCAC |
| 5527 | SPAFB24D3.07c_DN | GTGAAGGGTTAGGGGCGGCG | 5629 | SPBC1105.12_DN | GGGCCGGACAAAAAAGGCAG |
| 5528 | SPAFB24D3.08c_UP | CTTCTCAACTCGCCTGCCCG | 5630 | SPBC1105.13c_UP | TGCTGGTTGACTCCGTGGGG |
| 5529 | SPAFB24D3.08c_DN | GTGCGGGAGTTAGCGTCG | 5631 | SPBC1105.13c_DN | GCCGCCCAATACCGAAGACG |
| 5530 | SPAFB24D3.09c_UP | ATTATGGAGCTAGCGGCCGG | 5632 | SPBC1105.14_UP | CGCTGCCGCATTTGAGAAAG |
| 5531 | SPAFB24D3.09c_DN | ATAAATGGCGATCGGGGCT | 5633 | SPBC1105.14_DN | CCGTTTCACTCGCATCGCAT |
| 5532 | SPAFB24D3.10c_UP | ATCTCCCGTTCGCGCTCTCC | 5634 | SPBC1105.15c_UP | GACGCACACTCCTCCCCCAT |
| 5533 | SPAFB24D3.10c_DN | CCAAATGAGGCAAGCGGGTG | 5635 | SPBC1105.15c_DN | CGCACCACACTAGCCCCCAC |
| 5534 | SPAFB2B4.01c_UP | GTAGGTAGCGCGCTGTACAA | 5636 | SPBC1105.16c_UP | TGTTCTCCCGCCCAGCCAGC |
| 5535 | SPAFB2B4.01c_DN | TGTAGCGATCGGGGAAGTC | 5637 | SPBC1105.16c_DN | AATGGACGGGGCAACACAGG |
| 5536 | SPAFB2B4.03_UP | GCTTGGACTGGGGGAAGGTTG | 5638 | SPBC1105.18c_UP | TCGGGGATAGCGGTTTGGA |
| 5537 | SPAFB2B4.03_DN | TACATACAGCGGGGAGGCGG | 5639 | SPBC1105.18c_DN | TCTGGTGCCGGGAATGAACA |
| 5538 | SPAFB2B4.04c_UP | CCGGCGATGTCGAGATGGAC | 5640 | SPBC115.01c_UP | CCGATGGGGCCAACCTGTTT |
| 5539 | SPAFB2B4.04c_DN | TGCTTACGACCGCGCCGATC | 5641 | SPBC115.01c_DN | TCCCGCATTCAGAGCCCATT |
| 5540 | SPAFB2B4.05_UP | GTCTTGGGTGCGAATGGCG | 5642 | SPBC115.02c_UP | AGAAACATCCGGGCGCACAA |
| 5541 | SPAFB2B4.05_DN | AGTCGCAGCGTGACTACCAG | 5643 | SPBC115.02c_DN | TTCGGAGACTTCGGGGGGTC |
| 5542 | SPAFB2B4.07_UP | CTGGGCTGAGGGAGGGACTG | 5644 | SPBC119.01_UP | CCCCTTCCACGTGCTTGCG |
| 5543 | SPAFB2B4.07_DN | ACATTGACCGCTTGGCCCTG | 5645 | SPBC119.01_DN | CGCGATTGGGCCTGTTTGCT |
| 5544 | SPAFB2C8.01_UP | TTGGGGTCATGGCGGGTCTA | 5646 | SPBC119.02_UP | TGACGTTCTTTTTGGCGGCG |
| 5545 | SPAFB2C8.03_DN | CGTGAGTTGCGAGGATGGCG | 5647 | SPBC119.02_DN | ATCGTCAACCGCCAAAACG |
| 5546 | SPAFB9E5.02c_UP | CCTATGACGGAACGGCCCAA | 5648 | SPBC119.03_UP | TTCAGCCCCGATCCAGAGCC |
| 5547 | SPAFB9E5.02c_DN | ACGAACCGCGTGGACGAAAC | 5649 | SPBC119.03_DN | CGACAAAGGAACGGCCGATG |
| 5548 | SPAFB9E5.03_UP | TGATTTGTCGGTTGGGCGTC | 5650 | SPBC119.04_UP | CTGCTTCTGCCGTTATCGACC |
| 5549 | SPAFB9E5.03_DN | ATCCTGTCCCCTCTTGGCA | 5651 | SPBC119.04_DN | CTGAAGACCCTGCGCGTGGG |
| 5550 | SPAFB9E5.04c_UP | GCCGACACCTGCCTGAAACC | 5652 | SPBC119.05c_UP | GCTTTCAGGGACGGGACCGG |
| 5551 | SPAFB9E5.04c_DN | GAAAGGAACGGGGCATCGA | 5653 | SPBC119.05c_DN | ATATCGGCCACCCCCTGCTC |
| 5552 | SPAFB9E5.05_UP | TACGCGGGTCGTCTGGCCTC | 5654 | SPBC119.06_UP | GGGTAAATGGGACCGTGCGG |
| 5553 | SPAFB9E5.05_DN | TAGGCGCCCACGCGTTTAGT | 5655 | SPBC119.06_DN | TACCTCTCCGCCCCACCTCC |
| 5554 | SPAFB9E5.06_UP | CGCCGCTTCACTATACCCCG | 5656 | SPBC119.07_UP | AGCCCTGCCAACCTACGTCG |
| 5555 | SPAFB9E5.06c_DN | GAACATCCCACAGGGGCGC | 5657 | SPBC119.07_DN | GTAGTGCGGGAAAAGGGGGC |
| 5556 | SPAFB9E5.07c_UP | GACAGGCAACTCAACCGCCA | 5658 | SPBC119.08_UP | CCTTACAACAACCGCCCCCC |
| 5557 | SPAFB9E5.07c_DN | AGGGCCGGATGTGCAGGTATG | 5659 | SPBC119.09_DN | AACCCCGTCCCGTCTTCGCT |
| 5558 | SPAFB9E5.08_UP | TTCCGCCGCACTGATTACGA | 5660 | SPBC119.12_UP | CCGTTATTGTGGTGCGCGGG |
| 5559 | SPAFB9E5.08_DN | TAGCGCCGGATGTTTCCAA | 5661 | SPBC119.12_DN | ACCACCCCTTAAACGGCCGC |
| 5560 | SPAPJ691.02_UP | TGCCTGGAGTGGGGGAGAT | 5662 | SPBC119.14_UP | CTACCCATCCCCTGCCGTCG |
| 5561 | SPAPJ691.02_DN | ATCAGCTCCAGGCCGGTCCA | 5663 | SPBC119.14_DN | CCGGAAGGGCGCACGGATTAT |
| 5562 | SPAPJ695.01c_UP | AGAAGCTTGGGCGTGGTA | 5664 | SPBC119.15_UP | CTCGGGAAACGGGGGCTTGAT |
| 5563 | SPAPJ695.01c_DN | TCCGGGTGCCTTACATTTGG | 5665 | SPBC119.15_DN | CGTAGGAACAGTGGCGCGAG |
| 5564 | SPAPJ596.01c_UP | TTGATCTGCCTTGGACCCCC | 5666 | SPBC119.15c_UP | AGTCAAAAGGCGCGAGTCC |
| 5565 | SPAPJ596.01c_DN | ACCACACCACAAAGCCGGCC | 5667 | SPBC119.15c_DN | CGCCAATGTCAACCCCGGAG |
| 5566 | SPAPJ596.02_UP | ACAAAAAGGGCGTCCTCGGG | 5668 | SPBC119.18_UP | AAGTGACCCGCAGTCGCACA |
| 5567 | SPAPJ596.02_DN | TGAGATTTGCGTCTTGCCGG | 5669 | SPBC119.18_DN | ACACAGGGCTAGTCCGCAGT |
| 5568 | SPAPJ598.03c_UP | GCGTATTGGTCGGTGGGCGA | 5670 | SPBC1198.01_UP | AAAAAAACTGGTCGGGGCG |
| 5569 | SPAPJ598.03c_DN | TCGCAGTTCCAGTCGTTCGCC | 5671 | SPBC1198.01_DN | GCCCACGCGACCATGCATCT |
| 5570 | SPAPJ760.02c_UP | CGGCGTTCACGACAGTGGTT | 5672 | SPBC1198.02_UP | GATGCGTTTTTGGGGCGAAG |
| 5571 | SPAPJ760.02c_DN | CAAGTGCCTGACGTTCGCCT | 5673 | SPBC1198.02_DN | CCCCCTTTTCTGTGGTCGCA |
| 5572 | SPAPJ760.03c_UP | TTAACGGGGCTGCGTGTGGC | 5674 | SPBC1198.03c_UP | CCCACACTTAAGCCGCAGC |
| 5573 | SPAPJ760.03c_DN | CTCACCGCGCCAGACGTTTT | 5675 | SPBC1198.03c_DN | CATGCCAATCCAGCCCCACG |
| 5574 | SPAPYUG7.03c_UP | CTTCCTGGCGGGCGTGTTT | 5676 | SPBC1198.05_UP | GCGTCTTTGTCGCCATGGGC |
| 5575 | SPAPYUG7.03c_DN | GGCTTGCGTTGGGAATTGG | 5677 | SPBC1198.05_DN | GCAAAGGGACAGGACCCGT |
| 5576 | SPAPYUG7.04c_UP | TGCAAAGGCGTCGTCAGGTT | 5678 | SPBC1198.06_UP | GCTTCTTGGGTGGCATTCGG |
| 5577 | SPAPYUG7.04c_DN | AGGACTCAATCCACCACCAC | 5679 | SPBC1198.06c_DN | CTCCCGAACAGGCAAACCGC |
| 5578 | SPAPYUG7.06_UP | CGACACCGAAGCAGGCAAC | 5680 | SPBC1198.07c_UP | TGCTGCTTTCGGTTCCCTCA |
| 5579 | SPAPYUG7.06_DN | GTCAACGGCACCCGTGTCCA | 5681 | SPBC1198.07c_DN | AAGGCACCCCACCCAGCATC |
| 5580 | SPAPYUK71.03c_UP | GCGCGGGGCATCTAGGTGT | 5682 | SPBC1198.08_UP | CAGCCAAGCCCTCCCTCCAC |
| 5581 | SPAPYUK71.03c_DN | CCCGCCTAGGATGCAAGTC | 5683 | SPBC1198.08_DN | CATAGCGCGCGGGAATCTCA |
| 5582 | SPBC106.02c_UP | GGAGTTTGGCCTGTACGCCC | 5684 | SPBC1198.09_UP | GCAAGGAGCGGAAGGCTGGG |
| 5583 | SPBC106.02c_DN | GCCGCAGAAAAGACCCGCTA | 5685 | SPBC1198.09_DN | GGGAGGGTTTCTGGCGGAG |
| 5584 | SPBC106.03_UP | TGCTCAACACACCGCCGACC | 5686 | SPBC1198.10c_UP | TGACGAATTTGAACCCGCG |
| 5585 | SPBC106.03_DN | CGTCGCGCGTGTCTCTGTCT | 5687 | SPBC1198.10c_DN | CCGAGGTTGTATGGGAGCGC |
| 5586 | SPBC106.04_UP | GGTCCCCAATTCCTCACGCCG | 5688 | SPBC11B10.01_UP | TGACGCGCCAGCCTTACTTG |
| 5587 | SPBC106.04_DN | GGTTAAGGAGCGAGGGGGCG | 5689 | SPBC11B10.01_DN | TTTTGGGGTTGGCGGTGGAC |
| 5588 | SPBC106.05c_UP | ACCCATCCCACGCAATCGAA | 5690 | SPBC11B10.02c_UP | TGGGTTCTAGCCGAGCGAC |
| 5589 | SPBC106.05c_DN | CGCACATATCGGTCCCCAGG | 5691 | SPBC11B10.02c_DN | ATCCCTGACAGGCCCTTGTG |
| 5590 | SPBC106.06_UP | CCGGGAATATCTAGGCGCCA | 5692 | SPBC11B10.03_UP | AGAGCGGCGACGAGGAGAGG |
| 5591 | SPBC106.06_DN | AGAAGCCGCGATCCCACGTC | 5693 | SPBC11B10.03_DN | TCGCCCTGACGCCTACCATT |
| 5592 | SPBC106.08c_UP | CCGTTCTCCCCCGATCCTCT | 5694 | SPBC11B10.04c_UP | GGCCGATGCCTAATGCTTGC |
| 5593 | SPBC106.08c_DN | CCGCCGGAGCACGAATAAAC | 5695 | SPBC11B10.04c_DN | CGTTCCAGGGTGGGCGCTTA |
| 5594 | SPBC106.09_UP | ATCGCAGTCTAGCCTTGCGG | 5696 | SPBC11B10.05c_UP | CACGCGCATCACCCACCGTCT |
| 5595 | SPBC106.09_DN | TGGGGTCCCACGCGTATCCAA | 5697 | SPBC11B10.05c_DN | CAAPTGCATCCACACAGGCCGT |
| 5596 | SPBC106.10_UP | CAGCCCCCAAAAGAGGCAGA | 5698 | SPBC11B10.06_UP | TGGGTGCGGATTCTAGGGCC |
| 5597 | SPBC106.10_DN | GGATAGGGAACTCGGGCGCG | 5699 | SPBC11B10.06_DN | AGACGGGGAGTAGGCGGTT |
| 5598 | SPBC106.11c_UP | CGGAACTGCTGCCCCACCTA | 5700 | SPBC11B10.07c_UP | TCTTGTTGTGGTGCGGGGCA |
| 5599 | SPBC106.11c_DN | CACGAGCGGAGGGAGGAATC | 5701 | SPBC11B10.07c_DN | ATGGGGGCTCAGGGAGAGG |
| 5600 | SPBC106.12c_UP | CAGTATGGCGACCAGCCTGT | 5702 | SPBC11B10.08_UP | ACCCGCGACCTTCACCACCGA |
| 5601 | SPBC106.12c_DN | TAACTAAACGGCGCGCCA | 5703 | SPBC11B10.08_DN | CAACCGCGCAAGGAGCATCA |
| 5602 | SPBC106.13_UP | CTCGCGGCCACAAAAGCTCA | 5704 | SPBC11B10.09_UP | CCTGTGTCTGGCACCTGCG |
| 5603 | SPBC106.13_DN | GTTTGAGCGACGGCAGGTGA | 5705 | SPBC11B10.09_DN | GGGGCTTGGGGTACGTGAGG |
| 5604 | SPBC106.14c_UP | GTGATTTTCGGTGCGACGCC | 5706 | SPBC11B10.10c_UP | CCCCCTGTGGATGTTTGGCC |
| 5605 | SPBC106.14c_DN | TACTTGGTCTGCCCGCCTGGC | 5707 | SPBC11B10.10c_DN | TGGCGGGTAGGTCGAGGAAC |
| 5606 | SPBC106.16_UP | ACTCCCATCCAACCGACCCA | 5708 | SPBC11C11.02_UP | GCCTTGGGTGGTGCCGTTAT |
| 5607 | SPBC106.16_DN | ATGATGTACCCGCGGCCTTC | 5709 | SPBC11C11.02_DN | CAGGGGTACGGGACGGGAAT |
| 5608 | SPBC106.17c_UP | CGCCGGCCTTTTCATTGGTA | 5710 | SPBC11C11.03_UP | CCCAAGGTTCGCACTCGGTC |
| 5609 | SPBC106.17c_DN | TGAACCGGACCACCCAGCTA | 5711 | SPBC11C11.03_DN | TTGGGCCGCGGTGTAAATC |
| 5610 | SPBC1105.02c_UP | CGAAAGGTCAACGGCAGGGC | 5712 | SPBC11C11.05_UP | TTGCTTGCGCGGACTTTTCG |

FIG.35

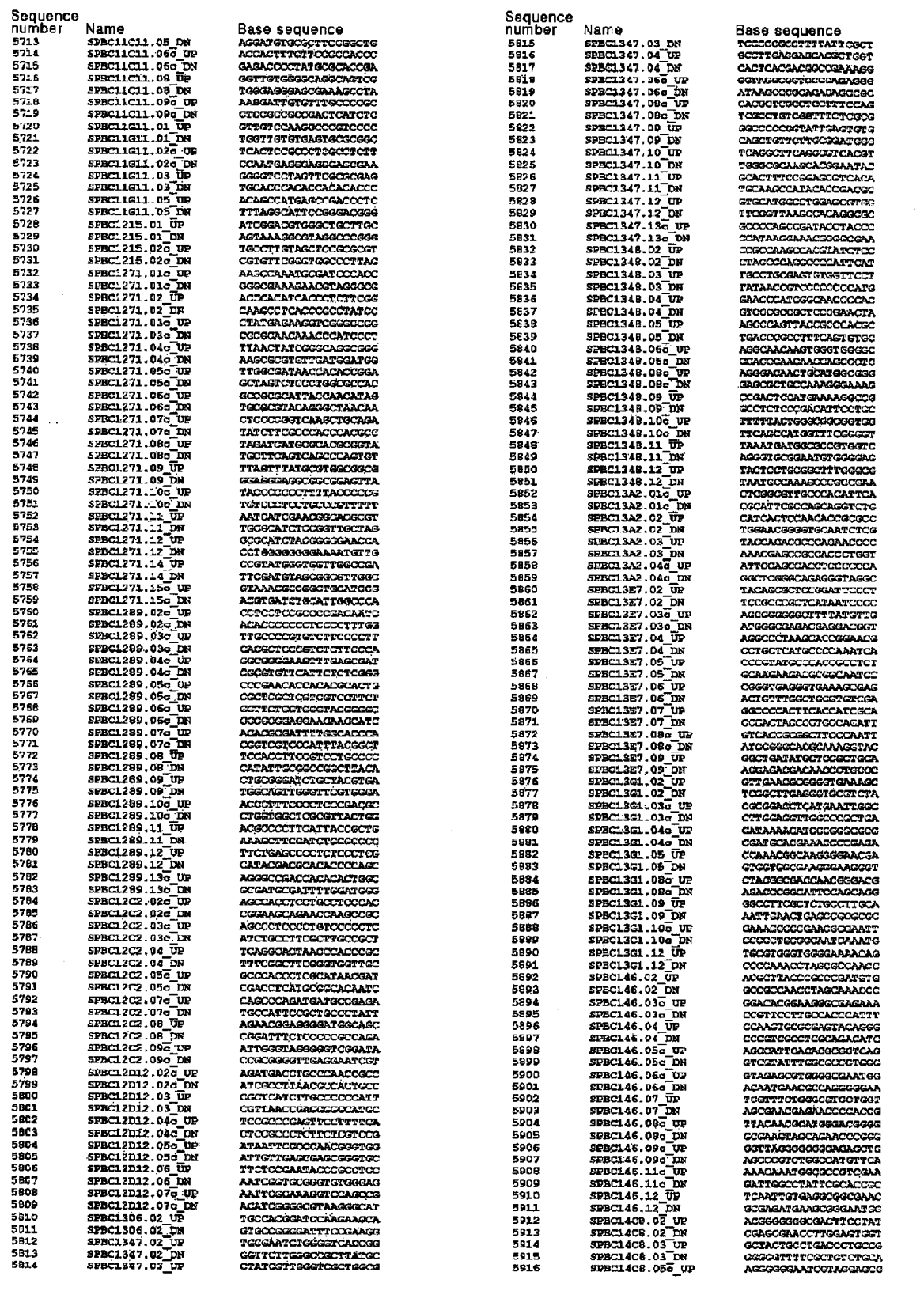

| Sequence number | Name | Base sequence |
|---|---|---|
| 5713 | SPBC11C11.05_DN | AGGATGTGCGCTTCCGGCTG |
| 5714 | SPBC11C11.06c_UP | ACCACTTTGTTCCGCCACCC |
| 5715 | SPBC11C11.06c_DN | GAGACCCCTATGCGCACCGA |
| 5716 | SPBC11C11.08_UP | GGTTGTGGGGCAGGCAGTCG |
| 5717 | SPBC11C11.08_DN | TGGGAGGGAGCGAAAGCCTA |
| 5718 | SPBC11C11.09c_UP | AAGGATTGTGTTTGCCCCGC |
| 5719 | SPBC11C11.09c_DN | CTCCGCCGCCGACTCATCTC |
| 5720 | SPBC11G11.01_UP | GTTGTCCAAGGCCCGTCCCC |
| 5721 | SPBC11G11.01_DN | TGGTTGTGTGAGTGCGCGGC |
| 5722 | SPBC11G11.02c_UP | TCACTCCGCCCTCGCCTCTT |
| 5723 | SPBC11G11.02c_DN | CCAATGAGGGAGGGAGCGAA |
| 5724 | SPBC11G11.03_UP | GGGGTCCTAGTTCGCGCGAG |
| 5725 | SPBC11G11.03_DN | TGCACCCACACCACACACCC |
| 5726 | SPBC11G11.05_UP | ACAGCCATGAGCCGACCCTC |
| 5727 | SPBC11G11.05_DN | TTTAGGCATTCCGGGACGGG |
| 5728 | SPBC1215.01_UP | ATCGGACGTGGGCTGCTTGC |
| 5729 | SPBC1215.01_DN | AGTAAAGGCGTAGGCCCGGG |
| 5730 | SPBC1215.02c_UP | TGCCTTGTAGCTCCGCGCGT |
| 5731 | SPBC1215.02c_DN | CGTGTTCGGGTGGCCCTTAG |
| 5732 | SPBC1271.01c_UP | AAGCCAAATGCGATCCCACC |
| 5733 | SPBC1271.01c_DN | GGGCGAAAGAACGTAGGGCC |
| 5734 | SPBC1271.02_UP | ACCCACATCACCCTCTTCGG |
| 5735 | SPBC1271.02_DN | CAAGCCTCACCCGCCTATCC |
| 5736 | SPBC1271.03c_UP | CTATGAGAAGGTCGGGGCGG |
| 5737 | SPBC1271.03c_DN | CGCGCAACAAACCCATCCCT |
| 5738 | SPBC1271.04c_UP | TTAACTATCGGGCAGGCGGG |
| 5739 | SPBC1271.04c_DN | AAGCGCGTGTTGATGGATGG |
| 5740 | SPBC1271.05c_UP | TTGGCGATAACCACACCGGA |
| 5741 | SPBC1271.05c_DN | GCTAGTCTCCCTGGCGCCAC |
| 5742 | SPBC1271.06c_UP | GCCGCGCATTACCAACATAG |
| 5743 | SPBC1271.06c_DN | TGCGCGTACAGGGCTAACAA |
| 5744 | SPBC1271.07c_UP | CTCCCCGGTCAAGCTGCAGA |
| 5745 | SPBC1271.07c_DN | TATCTTCGCCCACCCACGCC |
| 5746 | SPBC1271.08c_UP | TAGATCATGCGCACGCGGTA |
| 5747 | SPBC1271.08c_DN | TGCTTCAGTCAGCCCAGTGT |
| 5748 | SPBC1271.09_UP | TTAGTTTATGCGTGGCGGCG |
| 5749 | SPBC1271.09_DN | GGAGGGAGGCGGCGGAGTTA |
| 5750 | SPBC1271.10c_UP | TACCCCCCCTTTTACCCCCG |
| 5751 | SPBC1271.10c_DN | TGTCCCTCCTGCCCGTTTTT |
| 5752 | SPBC1271.11_UP | AATCATCGAACGGCACGCGT |
| 5753 | SPBC1271.11_DN | TGCGCATCTCCGGTTGCTAG |
| 5754 | SPBC1271.12_UP | GCGCATCTACGGGGGAACCA |
| 5755 | SPBC1271.12_DN | CCTGGGGGGGAAAATGTTG |
| 5756 | SPBC1271.14_UP | CCGTATGGGTGGTTGGCCGA |
| 5757 | SPBC1271.14_DN | TTCGATGTAGCGGCGTTGGC |
| 5758 | SPBC1271.15c_UP | GTAAACGCCGGCTGCATCCG |
| 5759 | SPBC1271.15c_DN | ACGTGATCTGCATTGGCCCA |
| 5760 | SPBC1289.02c_UP | CCTCCTCCGCCCCGACAATC |
| 5761 | SPBC1289.02c_DN | ACACCCCCCCTCCCCTTTGG |
| 5762 | SPBC1289.03c_UP | TTGCCCCGTGTCTTCCCCTT |
| 5763 | SPBC1289.03c_DN | CACGCTCCCGTCTCTTCCCA |
| 5764 | SPBC1289.04c_UP | GGCGGGGAAGTTTGAGCGAT |
| 5765 | SPBC1289.04c_DN | CGCGTGTTCATTCTCTCGGG |
| 5766 | SPBC1289.05c_UP | CCCGAACACCACACGCACTG |
| 5767 | SPBC1289.05c_DN | CGCTCGCTCGTCGTCCTTCT |
| 5768 | SPBC1289.06c_UP | GCTTCTGGTGGGTACGGGGC |
| 5769 | SPBC1289.06c_DN | GCCGCGGAGGAAGAAGCATC |
| 5770 | SPBC1289.07c_UP | ACACGCGATTTTGGCACCCA |
| 5771 | SPBC1289.07c_DN | CGGTCGTCCCATTTACGGCT |
| 5772 | SPBC1289.08_UP | TCCACCTTCCGTCCTGCCCC |
| 5773 | SPBC1289.08_DN | CATATTCCGGCCGGCTTACA |
| 5774 | SPBC1289.09_UP | CTGCGGGATCTGCTACGTGA |
| 5775 | SPBC1289.09_DN | TGGCAGTTGGGTTCGTGGGA |
| 5776 | SPBC1289.10c_UP | ACCCTTTCCCCTCCCGACGC |
| 5777 | SPBC1289.10c_DN | CTGGTGGCTCGCGTTACTGC |
| 5778 | SPBC1289.11_UP | ACGCCCCTTCATTACCGCTG |
| 5779 | SPBC1289.11_DN | AAAGCTTCGATCTGCGCCCC |
| 5780 | SPBC1289.12_UP | TTCTGAGCCCCTCTCCCTCG |
| 5781 | SPBC1289.12_DN | CATACGACGCACACCCCAGC |
| 5782 | SPBC1289.13c_UP | AGGGCCGACCACACACTGGC |
| 5783 | SPBC1289.13c_DN | GCGATGCGATTTTGGATGGG |
| 5784 | SPBC12C2.02c_UP | AGCCACCTCCTGCCTCCCAC |
| 5785 | SPBC12C2.02c_DN | CGGAAGCAGAACCAAGCCGC |
| 5786 | SPBC12C2.03c_UP | AGCCCTCCCCTGTCCCCCTC |
| 5787 | SPBC12C2.03c_DN | ATCTGCCTTCGCTTGCCGCT |
| 5788 | SPBC12C2.04_UP | TCAGGCACTAACCCACCCGC |
| 5789 | SPBC12C2.04_DN | TTTCGGCTTCGGGTGGTTGC |
| 5790 | SPBC12C2.05c_UP | GCCCACCCTCGCATAACGAT |
| 5791 | SPBC12C2.05c_DN | CGACCTCATGCGGCACAATC |
| 5792 | SPBC12C2.07c_UP | CAGCCCAGATGATGCCGAGA |
| 5793 | SPBC12C2.07c_DN | TGCCATTCCGCTGCCCTATT |
| 5794 | SPBC12C2.08_UP | AGAACGGAGGGGATGGCAGC |
| 5795 | SPBC12C2.08_DN | CGGATTTCTCCCCCGCCAGA |
| 5796 | SPBC12C2.09c_UP | ATTGGGTAGGGGGTCGGATA |
| 5797 | SPBC12C2.09c_DN | CCGCGGGGTTGAGGAATCGT |
| 5798 | SPBC12D12.02c_UP | AGATGACCTGCCCAACCGCC |
| 5799 | SPBC12D12.02c_DN | ATCGCCTTAACGCCACTGCC |
| 5800 | SPBC12D12.03_UP | CGCTCATCTTGCCCCCCATT |
| 5801 | SPBC12D12.03_DN | CGTTAACCGAGGGGGCATGC |
| 5802 | SPBC12D12.04c_UP | TCCGCCCGAGTTCCTTTTCA |
| 5803 | SPBC12D12.04c_DN | CTCCGCCCTCTTCTCGTCCG |
| 5804 | SPBC12D12.05c_UP | ATAATTCGCCCAACGGGTGG |
| 5805 | SPBC12D12.05c_DN | ATTGTTGAGCGAGCGGGTGC |
| 5806 | SPBC12D12.06_UP | TTCTCCGAATACCCGCCTCC |
| 5807 | SPBC12D12.06_DN | AATCGGTGCGGGTGTGGGAG |
| 5808 | SPBC12D12.07c_UP | AATTCGCAAAGGTCCAGCCG |
| 5809 | SPBC12D12.07c_DN | ACATCGGGGCGTAAGGGCAT |
| 5810 | SPBC1306.02_UP | TGCCACGGATCCAAGAAGCA |
| 5811 | SPBC1306.02_DN | GTGCCGGGGATTTCCGAAGG |
| 5812 | SPBC1347.02_UP | TGCGAATCTGGGGTCACCGG |
| 5813 | SPBC1347.02_DN | GGTTCTTGGGCCGCTTATGC |
| 5814 | SPBC1347.03_UP | CTATCGTTGGGTCGCTGGCG |
| 5815 | SPBC1347.03_DN | TCCCCCGCCTTTTATTCGCT |
| 5816 | SPBC1347.04_UP | GCCTTGAGGAGCACGCTGGT |
| 5817 | SPBC1347.04_DN | CACTCACGACGGCCGAAAGG |
| 5818 | SPBC1347.06c_UP | GGTAGGCGGTGCGGAGAGGG |
| 5819 | SPBC1347.06c_DN | ATAAGCCCGCACACAGCCGC |
| 5820 | SPBC1347.08c_UP | CACGCTCGCCTCCTTTCCAG |
| 5821 | SPBC1347.08c_DN | TCGCCTGTCGGTTTCTCGCG |
| 5822 | SPBC1347.09_UP | GGCCCCCGGTATTGAGTGTG |
| 5823 | SPBC1347.09_DN | CAGCTGTTCTTGCGGATGGG |
| 5824 | SPBC1347.10_UP | TCAGGCTTCAGCCGTCACGT |
| 5825 | SPBC1347.10_DN | TGGGCGCAAGCACGGAATAC |
| 5826 | SPBC1347.11_UP | GCACTTTCCGGAGCGTCACA |
| 5827 | SPBC1347.11_DN | TGCAAGCCATACACCGACGC |
| 5828 | SPBC1347.12_UP | GTGCATGGCCTGGAGCGTGG |
| 5829 | SPBC1347.12_DN | TTCGGTTAAGCCACAGGCGC |
| 5830 | SPBC1347.13c_UP | GCCCCAGCCGATACCTACCC |
| 5831 | SPBC1347.13c_DN | CCATAAGGAAACGGGGCGAA |
| 5832 | SPBC1348.02_UP | CCGCCAAGCCACGTATCTCC |
| 5833 | SPBC1348.02_DN | CTAGCCCAGGCCCCATTCAT |
| 5834 | SPBC1348.03_UP | TGCCTGCGAGTGTGGTTCCT |
| 5835 | SPBC1348.03_DN | TATAACCGTCCCCCCCCATG |
| 5836 | SPBC1348.04_UP | GAACCCATCGGCAACCCCAC |
| 5837 | SPBC1348.04_DN | GTCCCGCCGCTCCCGAACTA |
| 5838 | SPBC1348.05_UP | AGCCCAGTTACCGCCCACGC |
| 5839 | SPBC1348.05_DN | TGACCGGCCTTTCAGTGTGC |
| 5840 | SPBC1348.06c_UP | AGGCAACAAGTGGGTGGGGC |
| 5841 | SPBC1348.06c_DN | GCAGCCAACAACCAGCCCTC |
| 5842 | SPBC1348.08c_UP | AGGGACAACTGCATGGCGGG |
| 5843 | SPBC1348.08c_DN | GAGCGCTGCCAAAGGGAAAG |
| 5844 | SPBC1348.09_UP | CCGACTCCATGAAAAGGCCG |
| 5845 | SPBC1348.09_DN | GCCTCTCCCGACATTCCTGC |
| 5846 | SPBC1348.10c_UP | TTTTTACTGGGCGGCGGTGG |
| 5847 | SPBC1348.10c_DN | TTCAGCCATGGTTTCGGGGT |
| 5848 | SPBC1348.11_UP | TAAATGATGGCGCCGTGGTC |
| 5849 | SPBC1348.11_DN | AGGGTGCGGAATGTGGGGAG |
| 5850 | SPBC1348.12_UP | TACTCCTGCGGCTTTGGGCG |
| 5851 | SPBC1348.12_DN | TAATGCCAAAGCCCGCCGAA |
| 5852 | SPBC13A2.01c_UP | CTCGGCGTTGCCCACATTCA |
| 5853 | SPBC13A2.01c_DN | CGCATTCGCCAGCAGGTCTG |
| 5854 | SPBC13A2.02_UP | CATCACTCCAACACCGCGCC |
| 5855 | SPBC13A2.02_DN | TGGAACGGGGTGCAATCTCG |
| 5856 | SPBC13A2.03_UP | TAGCAGACGCCCAGAACCCC |
| 5857 | SPBC13A2.03_DN | AAACGAGCCGCCACCCTGGT |
| 5858 | SPBC13A2.04c_UP | ATTCCAGCCACCTCCCCCCA |
| 5859 | SPBC13A2.04c_DN | GGCTCGGGCAGAGGGTAGGC |
| 5860 | SPBC13E7.02_UP | TACAGCGCTCCGGATTCCCT |
| 5861 | SPBC13E7.02_DN | TCCGCCCGCTCATAATCCCC |
| 5862 | SPBC13E7.03c_UP | AGCCGGGGGCTTTTATGTTG |
| 5863 | SPBC13E7.03c_DN | ATGGGCGAGACGAGGACGGT |
| 5864 | SPBC13E7.04_UP | AGGCCCTAAGCACCGGAACG |
| 5865 | SPBC13E7.04_DN | CCTGCTCATGCCCCAAATCA |
| 5866 | SPBC13E7.05_UP | CCCGTATGCCCACCGCCTCT |
| 5867 | SPBC13E7.05_DN | GCAAGAAGACGCGGCAATCC |
| 5868 | SPBC13E7.06_UP | CGGGTGAGGGTGAAAGCGAG |
| 5869 | SPBC13E7.06_DN | ACTGTTTGGCTGCGTGTCGA |
| 5870 | SPBC13E7.07_UP | GGCCCCACTTCACCATCGCA |
| 5871 | SPBC13E7.07_DN | CCGACTACCCCTGCCAGATT |
| 5872 | SPBC13E7.08c_UP | GTCACCGCGGCTTCCCAATT |
| 5873 | SPBC13E7.08c_DN | ATCCGGGCACGCAAAGGTAC |
| 5874 | SPBC13E7.09_UP | GGCTGATATGCTCGGCTGCA |
| 5875 | SPBC13E7.09_DN | ACGAGACGACAACCCTGCCC |
| 5876 | SPBC13G1.02_UP | GTTGAACGCGGGGTGAAAGC |
| 5877 | SPBC13G1.02_DN | TCGGCTTGAGCGTGCGTCTA |
| 5878 | SPBC13G1.03c_UP | CGCGGAGCTCATGAATTGGC |
| 5879 | SPBC13G1.03c_DN | CTTGCAGGTTGGCCCGCTCA |
| 5880 | SPBC13G1.04c_UP | CATAAAACATCCCGGGCGCG |
| 5881 | SPBC13G1.04c_DN | CGATGCACGAAACCCCGAGA |
| 5882 | SPBC13G1.05_UP | CCAAACGGCAAGGGGAACGA |
| 5883 | SPBC13G1.05_DN | GTGGTGGCGAAGGGAAGGGT |
| 5884 | SPBC13G1.08c_UP | CTACGGCGACCAACGGGACG |
| 5885 | SPBC13G1.08c_DN | AGACCCGGCATTCCAGCAGG |
| 5886 | SPBC13G1.09_UP | GGCCTTCGCTCTGCCTTGCA |
| 5887 | SPBC13G1.09_DN | AATTGAACTGAGCCGCGCGC |
| 5888 | SPBC13G1.10c_UP | GAAAGGCCCGAACGCGAATT |
| 5889 | SPBC13G1.10c_DN | CCCCCTGCGGCAATCAAATG |
| 5890 | SPBC13G1.12_UP | TGCGTGGGTGGGGAAAACAG |
| 5891 | SPBC13G1.12_DN | CCCCAAACCTAGCGCCAACC |
| 5892 | SPBC146.02_UP | ACGCTTACCCGCCCGATGTG |
| 5893 | SPBC146.02_DN | GCCGCCAACCTAGCAAACCC |
| 5894 | SPBC146.03c_UP | GGACACGGAAGGGCGAGAAA |
| 5895 | SPBC146.03c_DN | CCGTTCCTTGCCACCCATTT |
| 5896 | SPBC146.04_UP | CCAAGTGCGCGAGTACAGGG |
| 5897 | SPBC146.04_DN | CCCGTCGCCTCGCAGACATC |
| 5898 | SPBC146.05c_UP | AGCCATTCACACGCGGTCAG |
| 5899 | SPBC146.05c_DN | GTCGTATTTGGCGCCCTGGG |
| 5900 | SPBC146.06c_UP | GTAGAGCGTGGGGCGAATGG |
| 5901 | SPBC146.06c_DN | ACAATGAACGCCAGGGGGAA |
| 5902 | SPBC146.07_UP | TCGTTTCTGGGCGTGCTGGT |
| 5903 | SPBC146.07_DN | AGCGAACGAGAACCCCACCG |
| 5904 | SPBC146.09c_UP | TTACAACGCATGGGACGGGG |
| 5905 | SPBC146.09c_DN | GCGAAGTAGCAGAACCCGGG |
| 5906 | SPBC146.09c_UP | GGTTAGGGGGGGGAGAGCTG |
| 5907 | SPBC146.09c_DN | AGCCCGTCTGGCCATGTTCA |
| 5908 | SPBC146.11c_UP | AAACAAATGGCGCCGTCGAA |
| 5909 | SPBC146.11c_DN | GATTGGCCTATTCGCACCGC |
| 5910 | SPBC146.12_UP | TCAATTGTGAGGCGGCGAAC |
| 5911 | SPBC146.12_DN | GCGAGATGAAGCGGGAATGG |
| 5912 | SPBC14C8.02_UP | ACGGGGGGCGACTTCCTAT |
| 5913 | SPBC14C8.02_DN | CGAGCGAACCTTGGAGTGGT |
| 5914 | SPBC14C8.03_UP | GCTACTGCCTGACCCTGCCG |
| 5915 | SPBC14C8.03_DN | GGGGGTTTTCGCTGTCTGCA |
| 5916 | SPBC14C8.05c_UP | AGGGGGGAATCGTAGGAGCG |

FIG.36

| Sequence number | Name | Base sequence | Sequence number | Name | Base sequence |
|---|---|---|---|---|---|
| 5917 | SPBC14C8.05q_DN | GTTCCCCTGCCTCTTGCTGC | 6019 | SPBC1604.13c_DN | AATGAATGGTCAGCACGGGA |
| 5918 | SPBC14C8.06_UP | AGTAGCCACTCCACGCGCGC | 6020 | SPBC1604.14c_UP | AATGCCGTTCCCTGTCCTG |
| 5919 | SPBC14C8.06_DN | TACCGCTTCCCGGGTTCCTC | 6021 | SPBC1604.14c_DN | GCCGTACTACAGGGTCGCAA |
| 5920 | SPBC14C8.08c_UP | CCCTTCGATACCACCGCCAC | 6022 | SPBC1604.16c_UP | TAACCGAACCGCCTCACGCT |
| 5921 | SPBC14C8.08c_DN | CCGCCGATGTGAGTGATTGC | 6023 | SPBC1604.16c_DN | ACCTCGTTAGGGCCGATCCA |
| 5922 | SPBC14C8.09c_UP | CAGGGCGCAAGTGGGGTGTC | 6024 | SPBC1604.17c_UP | GCCCCCAGGCATCCGTCATT |
| 5923 | SPBC14C8.09c_DN | ACCCCACCGCGTTCATGCAG | 6025 | SPBC1604.17c_DN | ATGGAAGCGGCGAGCAAAGC |
| 5924 | SPBC14C8.10_UP | CGGGCCGCAACCCTTGATCT | 6026 | SPBC1604.18c_UP | GGGCGGCT7AACTTGGGGCA |
| 5925 | SPBC14C8.10_DN | TGTTATGCGGCACGACGGAC | 6027 | SPBC1604.18c_DN | GATCGGGGCCTGGGTGTGGT |
| 5926 | SPBC14C8.11c_UP | GGCTGTGGGCGAGGAGGGAG | 6028 | SPBC1604.19c_UP | CCCGAGCCGCCATAGACCTT |
| 5927 | SPBC14C8.11c_DN | AGAATCCGGCGCCATACAG | 6029 | SPBC1604.19c_DN | AATCCCCGTGTCCTCTCCCC |
| 5928 | SPBC14C8.12_UP | CCGTCGTTTCCCTAACCCCA | 6030 | SPBC1604.20c_UP | CAGCCCGTCGAACAGGCCAG |
| 5929 | SPBC14C8.12_DN | TTTCCGGACTTCCTGCCCAA | 6031 | SPBC1604.20c_DN | TCAGCCGAGCGCACATAAG |
| 5930 | SPBC14C8.13_UP | GATGATGTTCGGCCGGTTGGT | 6032 | SPBC1652.01_UP | AAGTGGGGTCGCCTATGGGA |
| 5931 | SPBC14C8.13_DN | TTGTGTTTTGAAGGCGCCGA | 6033 | SPBC1652.01_DN | GAGAATTGGGGGTCCCAGCC |
| 5932 | SPBC14C8.14c_UP | CATCTACGCCCAACCCGCTG | 6034 | SPBC1652.02_UP | GCGGCAGAGAGGCGGAAGAG |
| 5933 | SPBC14C8.14c_DN | GCGAAGACGAGAGGCTGGG | 6035 | SPBC1652.02_DN | AGACCGCCCAAACCCCAACG |
| 5934 | SPBC14C8.15_UP | GGTCTCCGCCGCCTCCTTAC | 6036 | SPBC1677.02_UP | CCTTGCAAAAACCCGGGGAA |
| 5935 | SPBC14C8.15_DN | CCGAGACGAAATGACGCGCA | 6037 | SPBC1677.02_DN | CGGGGGCAAGTGACGGGCTC |
| 5936 | SPBC14C8.16c_UP | ACCAAGGCCGCACCGATGAT | 6038 | SPBC1683.01_UP | TACAGACCGGCCTTCCGTG |
| 5937 | SPBC14C8.16c_DN | GCTGCCTTACGCGGGATTGG | 6039 | SPBC1683.01_DN | TGGGAGGTGTTGGCGTGAG |
| 5938 | SPBC14C8.17c_UP | TAATGGTCTTGGAGGTGGCG | 6040 | SPBC1683.02_UP | GCAGCAAAGCCGACTACCCG |
| 5939 | SPBC14C8.17c_DN | ACAGGGACCGATGAGAGGCG | 6041 | SPBC1683.02_DN | TCGCCTCGGTATCTTTCGGC |
| 5940 | SPBC14F5.01_UP | CGGATCCGGACTCGCTCATT | 6042 | SPBC1683.03c_UP | CGTTCCCCATCCCCATCCAC |
| 5941 | SPBC14F5.01_DN | TGAGCTCGACCGCACTAGGT | 6043 | SPBC1683.03c_DN | TCCTGCCCGACCTTTTGTGC |
| 5942 | SPBC14F5.02_UP | GCAGCAGTACGGGCCAACAA | 6044 | SPBC1683.04_UP | CGCCCAGCAGAGTTTCACCC |
| 5943 | SPBC14F5.02_DN | TCGCGGTGGTGCAAAGGAAA | 6045 | SPBC1683.04_DN | AGGCCGGCTCCCAACAAGAC |
| 5944 | SPBC14F5.04c_UP | CTTTCTCCGCTTGCCCGTTC | 6046 | SPBC1683.05_UP | TACTCGCCACCACCCCCATT |
| 5945 | SPBC14F5.04c_DN | GGACGGGCAGGGGAAAGACA | 6047 | SPBC1683.05_DN | CCACCCCGTCACACGCAATA |
| 5946 | SPBC14F5.06_UP | GCACGCCACGAAAAGGAAA | 6048 | SPBC1683.06c_UP | GAGCAGGGAATTTGACGGCG |
| 5947 | SPBC14F5.06_DN | AGGCACTGGCGGGTATTTGG | 6049 | SPBC1683.06c_DN | AACGGCAATAGCCACCCTGC |
| 5948 | SPBC14F5.07_UP | GTGCGTTTGGACCCTGTGGC | 6050 | SPBC1683.07_UP | TCATGTCCACCCTGTCCCAC |
| 5949 | SPBC14F5.07_DN | TCGTTCCGGCGGTTACTCC | 6051 | SPBC1683.07_DN | CACCCTCACCCTCGCCTCCAT |
| 5950 | SPBC14F5.08_UP | GCGGTTGCTGCTTTGATGA | 6052 | SPBC1683.08_UP | AGCAGGGCAACAGCTAAGGA |
| 5951 | SPBC14F5.08_DN | CCCGCCGTCTTGCTGCTATT | 6053 | SPBC1683.08_DN | TCGGCTCGGTCCTCCCCTCT |
| 5952 | SPBC14F5.09c_UP | ACACCCAGTCCAGGCCCAGC | 6054 | SPBC1683.09c_UD | TCACAAGCGGCAACCTACGG |
| 5953 | SPBC14F5.09c_DN | TGCGGTCGGGTAATGCCTCT | 6055 | SPBC1683.09c_DN | ACCGGACAGCCCAACAACGT |
| 5954 | SPBC14F5.10c_UP | ACGGCACACGACGATACGGAA | 6056 | SPBC1683.10c_UP | CCGGCTGCGCTCCCTTTCTT |
| 5955 | SPBC14F5.10c_DN | AATGATGTGTCGGCCGCGAT | 6057 | SPBC1683.10c_DN | CCTCCCATCCCTCCCCACGT |
| 5956 | SPBC14F5.11c_UP | CATTCCTCGTGCTTTCCCCG | 6058 | SPBC1683.11c_UP | ACCGCCCCCCAGCAATAAGC |
| 5957 | SPBC14F5.11c_DN | CATGGCAAAGTCGGGAAGCG | 6059 | SPBC1683.11c_DN | TGGGACAGGGCGGAGTAGCA |
| 5958 | SPBC14F5.12c_UP | GGGCGTAGGCACTTCTTGGC | 6060 | SPBC1683.12_UP | ACCGTGGGCGGGTGAACATT |
| 5959 | SPBC14F5.12c_DN | TTGTTTCGGGGATCGCTACC | 6061 | SPBC1683.12_DN | TCACACCTCACCCCGTTCGC |
| 5960 | SPBC14F5.13c_UP | TCATGACACGTCGCGGGGTA | 6062 | SPBC1683.13c_UP | ACAGGAAGGACCGCGTGCAG |
| 5961 | SPBC14F5.13c_DN | TGCGTGCCACGTCATCGAAT | 6063 | SPBC1683.13c_DN | CCGCTGCCTAATTAAGCCCG |
| 5962 | SPBC1539.02_UP | GGACCACGCCAAGGACCTGA | 6064 | SPBC1685.01_UP | TGCGGAAAACTACGGGGCAG |
| 5963 | SPBC1539.02_DN | CATGGGTTTCAGGTGCGCT | 6065 | SPBC1685.01_DN | TTTCGGCTCTTGCGTCCCTC |
| 5964 | SPBC1539.03c_UD | CCCACCGCAACGCCATTCCAC | 6066 | SPBC1685.02c_UP | CTGTCTATGCGGAGGTGGCG |
| 5965 | SPBC1539.03c_DN | GTGCGTTACTGTTGCCGGCG | 6067 | SPBC1685.02c_DN | CTCCGTCGCTCGTGCTTGTG |
| 5966 | SPBC1539.04_UP | CGGGGACACAGGGGATGAGG | 6068 | SPBC1685.03_UP | GGGGGTTCACTAGTCGGGGGG |
| 5967 | SPBC1539.04_DN | TTCACCCCCAGACCCGTTCT | 6069 | SPBC1685.03_DN | CGCTCCCCGCCTTTACCCTA |
| 5968 | SPBC1539.05_UP | TTCCGTAAGGTCGAGCCGGG | 6070 | SPBC1685.04_UP | GACGGTGTGCGGGATATCGG |
| 5969 | SPBC1539.05_DN | CGCGGGAAGCTGTAGTGGGG | 6071 | SPBC1685.04_DN | AAACCAACGCGGAGGAAGCC |
| 5970 | SPBC1539.07c_UP | AGTGCTCTGCCGCGTTGGTC | 6072 | SPBC1685.05_UP | CCTAGCATCCCAAACGCGCA |
| 5971 | SPBC1539.07c_DN | TGATAATGCGCAGGACGGGG | 6073 | SPBC1685.05_DN | ATTAAACCCGGCCGCGACCA |
| 5972 | SPBC1539.09_UP | AGAATGGAAACGTGCGCCCC | 6074 | SPBC1685.06_UP | AATAATGCGCCAACCCCCAC |
| 5973 | SPBC1539.09_DN | TCCACCCCGCCTCAATCTA | 6075 | SPBC1685.06_DN | TACTTCCCCTGCTTCGCCCA |
| 5974 | SPBC15C4.02_UP | TTGCCCGCTGTCCTCCTTGC | 6076 | SPBC1685.07c_UP | TAGCCCCGCCTCCGACAAT |
| 5975 | SPBC15C4.02_DN | CGGTGGTCGCGGTGAAFCTT | 6077 | SPBC1685.07c_DN | AGGTTGAGAGCAAGGGGGGG |
| 5976 | SPBC15C4.04c_UP | CGACGCCCACATACCTGAAA | 6078 | SPBC1685.08_UP | ACCAACGGACAAGCCCCACT |
| 5977 | SPBC15C4.04c_DN | ATACCCGCCTACCGACCGCA | 6079 | SPBC1685.08_DN | CCAATATTGTGCGCGGTGCC |
| 5978 | SPBC15C4.05_UP | CCGGAGCCACAGGGACAGCT | 6080 | SPBC1685.09_UP | GTCTGGGGCCTCGGCTTTTG |
| 5979 | SPBC15C4.05_DN | CATGCAGTCCGTGGGAGGGC | 6081 | SPBC1685.09_DN | TATGACCCTGACTCCGCCGC |
| 5980 | SPBC15D4.02_UP | ATTCATAACCGCGGGACAGCT | 6082 | SPBC1685.11_UP | TGACAGCCAACTCCAGCGCC |
| 5981 | SPBC15D4.02_DN | ACGCCTGCTTTGTGACCGAC | 6083 | SPBC1685.11_DN | CTTGTCCACTGACTGGCGCG |
| 5982 | SPBC15D4.03_UP | TTCCCTGCCAACGACACTGC | 6084 | SPBC1685.12c_UP | TGGTTGTGGTGCGAAGAGGG |
| 5983 | SPBC15D4.03_DN | CCCCCAGGCATCACATCACC | 6085 | SPBC1685.12c_DN | CGCCTCAGCCCCTTTCCTCG |
| 5984 | SPBC15D4.04_UP | ACCATGCGAAACGGCCAACT | 6086 | SPBC1685.13_UP | TCAATGTGGGGCGCGGATAG |
| 5985 | SPBC15D4.04_DN | GTCATAGAAGGGCCTGCGCC | 6087 | SPBC1685.13_DN | ACCTGCCGCAATGAAACGC |
| 5986 | SPBC15D4.05_UP | GTTCAAAAGAGGGCGGGGGC | 6088 | SPBC1685.14c_UP | TCCCGCATCGCCCTTACACA |
| 5987 | SPBC15D4.05_DN | TTTGAGGCGCGGATGGTTCA | 6089 | SPBC1685.14c_DN | TGCGGGTTGGCTTATGTGGC |
| 5988 | SPBC15D4.06_UP | CCAATACCGTTCCGCCTCGT | 6090 | SPBC1685.16_UP | ACTCGTACAGTCGACGCTCG |
| 5989 | SPBC15D4.06_DN | TGACGGGAGCAAGGCGATGA | 6091 | SPBC1685.16_DN | AAACCGCAGTGAGACGCGRA |
| 5990 | SPBC15D4.07c_UP | TCAGAAATCGCGAGGGGGGT | 6092 | SPBC16A3.03c_UP | GCGGGCCAAACGACCAAAACG |
| 5991 | SPBC15D4.07c_DN | AGAATTCGCAGACGCCCGGG | 6093 | SPBC16A3.03c_DN | GACTGGCGAGGCGAAGACGG |
| 5992 | SPBC15D4.09c_UP | AGAGCGGTGCGCGTATTCGA | 6094 | SPBC16A3.04_UP | AGGACACGGCCGACAGACAG |
| 5993 | SPBC15D4.09c_DN | CATGCGTTGCCGTTCCTTTG | 6095 | SPBC16A3.04_DN | TCCTTGGCTTGTGTGGCGTGC |
| 5994 | SPBC15D4.10c_UP | GGTAGTTTGTCCCGCCCGTC | 6096 | SPBC16A3.05c_UP | ACACAACGCCCCGAACCTCT |
| 5995 | SPBC15D4.10c_DN | TGGTGTTGGACGGATGGCTG | 6097 | SPBC16A3.05c_DN | CGCTCCCACTCCGCCCAAAT |
| 5996 | SPBC15D4.12c_UP | AGGCGCCTCGACTGAATTGC | 6098 | SPBC16A3.06_UP | CCGGTGTCTGTGCATGCT |
| 5997 | SPBC15D4.12c_DN | GGTCCGGAATACGCAAAAGC | 6099 | SPBC16A3.06_DN | CGGGGCTAATTGGTTGGTTG |
| 5998 | SPBC15D4.13c_UP | CGACCATACTCCCCGCTCCC | 6100 | SPBC16A3.07c_UP | AGACAGTTGACCGAGGGCGC |
| 5999 | SPBC15D4.13c_DN | GCCCCAAAACGTTCCAGCAC | 6101 | SPBC16A3.07c_DN | GACGAGGGGACGAGGGGATT |
| 6000 | SPBC15D4.15_UP | GGGGAGTCGGCATCACAGGGA | 6102 | SPBC16A3.08c_UP | CGACCGTACGGGACTTTCGC |
| 6001 | SPBC15D4.15_DN | TAACGTAGCGGCGAGAGCCA | 6103 | SPBC16A3.08c_DN | GGCCGTGGGATTACGCAAAA |
| 6002 | SPBC1604.02c_UP | TGTGGGCTGCTGGGGTCAAA | 6104 | SPBC16A3.09c_UP | TAAGGGGAGACTTGGTGCGA |
| 6003 | SPBC1604.02c_DN | CCCGCCGAGATTAGGTTGGC | 6105 | SPBC16A3.09c_DN | GCTGGCGGGAAGAGGAAAGC |
| 6004 | SPBC1604.03c_UP | ACACCCTGCCCCCTCTTCAA | 6106 | SPBC16A3.10_UP | CTTCTTCCGTTCGCCTCCGG |
| 6005 | SPBC1604.03c_DN | GCTCCGCCTCCCCCACCCTA | 6107 | SPBC16A3.10_DN | AGGGTCCGGTATGGCAGGGC |
| 6006 | SPBC1604.04_UP | GCCTATGATCGCGCGCTTTG | 6108 | SPBC16A3.11_UP | GGGGACGGACGACTGGGGAG |
| 6007 | SPBC1604.04_DN | GAAGTATGCGGCGACGCCTCG | 6109 | SPBC16A3.11_DN | ATCAGCAATCGGCCAACCCC |
| 6008 | SPBC1604.05_UP | GCGCCGTTCCGAAGTACCATG | 6110 | SPBC16A3.12c_UP | ACACAGGCCTCCTGAGCCGAA |
| 6009 | SPBC1604.05_DN | GCGCCTCCCTCTTCGTTGGAA | 6111 | SPBC16A3.12c_DN | AAGCGCCGCAATGTTAGTGTG |
| 6010 | SPBC1604.07_UP | CAAGGGTTTTGTCGGGGCA | 6112 | SPBC16A3.13_UP | CAACGCCTGCCCGACAGTTC |
| 6011 | SPBC1604.07_DN | GTGAGCGGAGGGGGCACTGT | 6113 | SPBC16A3.13_DN | AAAAAGAGGCAGGCGGGACG |
| 6012 | SPBC1604.10_UP | CGACAATCGAACTCCGCGGC | 6114 | SPBC16A3.14_UP | AATGCCTGAGCTCACCGACG |
| 6013 | SPBC1604.10_DN | CGGGGACGATCGTAGGCTGC | 6115 | SPBC16A3.14_DN | GTCACTGGTTGCGGCGTTG |
| 6014 | SPBC1604.11_UP | GGCAGGGGCTACATTCGGI | 6116 | SPBC16A3.15c_UP | GCCAAGGAGGGGGACTGGCT |
| 6015 | SPBC1604.11_DN | CGGTTGCTCGCTGTTTCGCT | 6117 | SPBC16A3.15c_DN | TGACAGTTTGACGGCGGGAG |
| 6016 | SPBC1604.12_UP | GAGCCGCGTGACAGGTATTG | 6118 | SPBC16A3.16_UP | TGACCCATAAGCCCCGGGAT |
| 6017 | SPBC1604.12_DN | AGGGGAGGGAGAGCTGCGGA | 6119 | SPBC16A3.16_DN | AGCGGCGAGGTTGCATATGC |
| 6018 | SPBC1604.13c_UP | GATATTCCGCCGGCCGACC | 6120 | SPBC16A3.17c_UP | TGCCGTGTTCTCCGCTTCCA |

FIG.37

| Sequence number | Name | Base sequence | Sequence number | Name | Base sequence |
|---|---|---|---|---|---|
| 6121 | SPBC16A3.17c_DN | TGAACGACCAAGCACCGCCC | 6223 | SPBC16G5.17_DN | GTGGTGACAGACGGCCAGGC |
| 6122 | SPBC16A3.18_UP | GTGGGTCGGACTTCGATCCT | 6224 | SPBC16G5.19_UP | ACTCTTAGGGCGCCCGTTAC |
| 6123 | SPBC16A3.18_DN | ACCCTCGTCGAGCTGGGAAT | 6225 | SPBC16G5.18_DN | GAGTGCGATTCGGGACGTA |
| 6124 | SPBC16C6.01c_UP | AGAATAGCAGGCCGCGGAAA | 6226 | SPBC16H5.C2_UP | ATCGCGGAGGGGCTAACACA |
| 6125 | SPBC16C6.01c_DN | TTTGGCGAGGTGGACAGGG | 6227 | SPBC16H5.02_DN | TGCTTGTCCGGCTCTTCGCT |
| 6126 | SPBC16C6.02c_UP | TTTGGCGCGCATTTTCACAT | 6228 | SPBC16H5.03c_UP | ACACCGCCCCACTCCAAAAA |
| 6127 | SPBC16C6.02c_DN | GCGCCAGATCTTTCCCCAC | 6229 | SPBC16H5.03c_DN | ATTGCGGGGGTCCAGTTGA |
| 6128 | SPBC16C6.03c_UP | AGCTAACCCGCCGCAACTGT | 6230 | SPBC16H5.04_UP | TTACCCCTTCGCCCGCACTT |
| 6129 | SPBC16C6.03c_DN | CCCCCGCTCTTGTACCCTCC | 6231 | SPBC16H5.04_DN | CGATGATTTGGGGTCGTGG |
| 6130 | SPBC16C6.04_UP | CCCCTGTCCCATCCCCGTCG | 6232 | SPBC16H5.05c_UP | CGTCCGCAGAACATGGCTCC |
| 6131 | SPBC16C6.04_DN | CGGGTGGGCAGCAGATTGGT | 6233 | SPBC16H5.05c_DN | TCCCGAGGCGTAGCACAGGA |
| 6132 | SPBC16C6.05_UP | GTAGGGAATCAGGGCGGGCG | 6234 | SPBC16H5.06_UP | CGGCCATAGTCGTCGGTTCT |
| 6133 | SPBC16C6.05_DN | GTCCTATCGAAACCCCGCGG | 6235 | SPBC16H5.06_DN | ACACCTGATCACCCCGCTC |
| 6134 | SPBC16C6.06_UP | AGGTCCAGATTCTCCGCGCC | 6236 | SPBC16H5.07c_UP | TGATTGCCTTGGGGGTGTGA |
| 6135 | SPBC16C6.06_DN | ACTGCAACCCCCGCTCATTA | 6237 | SPBC16H5.07c_DN | CCTTCATCCCTGCTGCCCGA |
| 6136 | SPBC16C6.07c_UP | ATTGGTTTTGGGCGCTCGGA | 6238 | SPBC16H5.08c_UP | TAGGGACCGACTGCCGGAAC |
| 6137 | SPBC16C6.07c_DN | AAAAGCGACGTGGGGCAAAC | 6239 | SPBC16H5.08c_DN | AATGACCCACGGGAGACGGT |
| 6138 | SPBC16C6.08c_UP | ATCCACCCCGCATAATCCCA | 6240 | SPBC16H5.09c_UP | CTCGCCGTCTTCTCTCGCT |
| 6139 | SPBC16C6.08c_DN | TGGGCTTTTGTTCGGATGCA | 6241 | SPBC16H5.09c_DN | GTTCGGCGTCCATTGCAGGT |
| 6140 | SPBC16C6.09_UP | ACGGGCATGGTCGACGGCTA | 6242 | SPBC16H5.11c_UP | TGCTCCAATCCCGACCCCAG |
| 6141 | SPBC16C6.09_DN | TTTCCAAGGGCGGGCGAGTT | 6243 | SPBC16H5.11c_DN | CTCCTCCGCCCTCGGCTAAC |
| 6142 | SPBC16C6.10_UP | GCCCGCATACTCGTCGTCT | 6244 | SPBC16H5.13_UP | TCTCAACGCCGTCTCCGCAC |
| 6143 | SPBC16C6.10_DN | CACATTCGGTGGTTCAGCGC | 6245 | SPBC16H5.13_DN | TTAGGCATTCTGGGACCGGG |
| 6144 | SPBC16C6.11_UP | TCGTTGGTTTCAGGGCGCAC | 6246 | SPBC16H5.14c_UP | ATGTAGGCGACTCTCCCGT |
| 6145 | SPBC16C6.11_DN | CCTTGGACCGCACCCTGGAC | 6247 | SPBC16H5.14c_DN | AACGCGGCTCTGTTCTACCG |
| 6146 | SPBC16D10.02_UP | TGGTCTGTTCGTGGGCATGG | 6248 | SPBC16H5.15_UP | TGCTTTCTGCGTCCGGCTGT |
| 6147 | SPBC16D10.02_DN | TCAGAAGGGGGTGCACAGGG | 6249 | SPBC16H5.15_DN | CGGAGTGGACACGACACTGA |
| 6148 | SPBC16D10.03_UP | CGCGACCCCACCGAGACCTA | 6250 | SPBC1703.01c_UP | GCGAATGGGAGCGAAAATCG |
| 6149 | SPBC16D10.03_DN | CTGTTCACTGCGCGCCCTCC | 6251 | SPBC1703.01c_DN | GGGGCGATGTGAGAGGCAAA |
| 6150 | SPBC16D10.04c_UP | TACGGGCTGCCACAGGTTAG | 6252 | SPBC1703.02_UP | TGTAACGACGGGGCGAAGC |
| 6151 | SPBC16D10.04c_DN | GGTGCAGGGGTACGAACTCT | 6253 | SPBC1703.02_DN | GACCCATCGAACCCGCCACA |
| 6152 | SPBC16D10.05_UP | CAAGGGGATCCCACAAGGCT | 6254 | SPBC1703.03c_UP | ATTGTCCCGTGCTTGGCCCC |
| 6153 | SPBC16D10.05_DN | GCCTACACGAGAACCGGCGT | 6255 | SPBC1703.03c_DN | GGCGGTTGTGGCTGATCGAC |
| 6154 | SPBC16D10.06_UP | GACGAAGAGGCGGGGGCAAGT | 6256 | SPBC1703.04_UP | ATAACCCACTGCCCGGACCA |
| 6155 | SPBC16D10.06_DN | CAAAACCCCCCAATCCCTGT | 6257 | SPBC1703.04_DN | CATCTCCTCGGCGACTCACG |
| 6156 | SPBC16D10.07c_UP | GGACAATCGGTGGGAGGGTG | 6258 | SPBC1703.05_UP | ATTGCGGGAAAGTGCGACCT |
| 6157 | SPBC16D10.07c_DN | AGCGACCACGAAGAACGGCG | 6259 | SPBC1703.05_DN | AGGTAAGCATGAACGTCGC |
| 6158 | SPBC16D10.08c_UP | AAAACAGTTGCCCGCCGAGCG | 6260 | SPBC1703.06_UP | CAAAAATTCCGCAAACGGCG |
| 6159 | SPBC16D10.08c_DN | GGGAGAAACGGGCAGGCCTA | 6261 | SPBC1703.06_DN | AGCCTTGCTGTCCGCCCTAG |
| 6160 | SPBC16D10.10_UP | AACCCGGACGAGCCCAAAGC | 6262 | SPBC1703.07_UP | CGGCGGAGAGGCAAAAGGCAA |
| 6161 | SPBC16D10.10_DN | GGAGAGGCCATGCAACACGC | 6263 | SPBC1703.07_DN | TTACCCGCCAGCATCCCAGG |
| 6162 | SPBC16D10.11c_UP | CCAAACGCCGACCGACAATC | 6264 | SPBC1703.08c_UP | CTCGCGTAGCCGTCGATCTA |
| 6163 | SPBC16D10.11c_DN | CCTTTTGTGTACCCTTCCCG | 6265 | SPBC1703.08c_DN | TCGCTGCGCAGGTCTTTAGG |
| 6164 | SPBC16E9.02c_UP | ATCGTGGAAGCTGCGCGGTC | 6266 | SPBC1703.09_UP | ACCCCTCGTGCTGGTTTGTC |
| 6165 | SPBC16E9.02c_DN | TGTGACTTGGAGGGCCGGTG | 6267 | SPBC1703.09_DN | CTGCCCTTCCCTAACCGCCT |
| 6166 | SPBC16E9.03c_UP | TGGGGTGTCGGGCAGGTAGC | 6268 | SPBC1703.12_UP | CCAGAAAGCGGTAGGGGTCG |
| 6167 | SPBC16E9.03c_DN | AACAGGGAAGGCCGACCAGG | 6269 | SPBC1703.12_DN | TGACAATCCCTGCGCCATCG |
| 6168 | SPBC16E9.05_UP | GGCTTGTCTCAGGGCGATCT | 6270 | SPBC1703.13c_UP | GGGGATGGGTTGTGGGACAG |
| 6169 | SPBC16E9.05_DN | GCTTACTAGGGTGCCAGCGT | 6271 | SPBC1703.13c_DN | AAGGTATGCGGTGCGGGTG |
| 6170 | SPBC16E9.06c_UP | CCGTTCGTCCCACCTTGCCA | 6272 | SPBC1703.14c_UP | AGGACCCGAGCACAACCCG |
| 6171 | SPBC16E9.06c_DN | AACAACCGAAGGGGCTGACG | 6273 | SPBC1703.14c_DN | GCGGGAACCGAAAGGAAGG |
| 6172 | SPBC16E9.07_UP | CGGCAGCGGACAAGAGAGGT | 6274 | SPBC1706.01_UP | CACTAAAAGCCTGCACCGCG |
| 6173 | SPBC16E9.07_DN | GGCTCACTTTCGCATTCCCC | 6275 | SPBC1706.01_DN | ACAAGCCGGGGTCAGTCCC |
| 6174 | SPBC16E9.08_UP | CGTAGATCCGCCAGAAGCCG | 6276 | SPBC1709.03_UP | TTCCGACCGGCCACTACACCC |
| 6175 | SPBC16E9.08_DN | GCCCCCTCCGTCACACACGA | 6277 | SPBC1709.03_DN | AGGGGTTGTCGTTATGGCGG |
| 6176 | SPBC16E9.10c_UP | GTTGTGGGTGGAGGGGGGCAG | 6278 | SPBC1709.04c_UP | GCAGTGGGGAGGAACGGAAC |
| 6177 | SPBC16E9.10c_DN | GCCCGTCCGTCCGAACCTT | 6279 | SPBC1709.04c_DN | TCCGACCCGACCACGCTTG |
| 6178 | SPBC16E9.11c_UP | GGTGTTGATGGCGGGGCTGT | 6280 | SPBC1709.05_UP | CAGAACGAATTCCCGATGCGGCC |
| 6179 | SPBC16E9.11c_DN | CATCTGGTCGGCGTTGTGGC | 6281 | SPBC1709.05_DN | AGTTAGGGGTTCCATCGCCG |
| 6180 | SPBC16E9.12c_UP | ACCCCCGGCCACCATCGATA | 6282 | SPBC1709.06_UP | GCGGAGGGGTGTCGGATAGC |
| 6181 | SPBC16E9.12c_DN | TGCGGAGATAGGGTCGGGGC | 6283 | SPBC1709.06_DN | ATGCTTCTCGGGGGGCTGCT |
| 6182 | SPBC16E9.13_UP | GGCGTCCCGAAGCATCAGCT | 6284 | SPBC1709.07_UP | ATACTCAGCCCTGGACCGGA |
| 6183 | SPBC16E9.13_DN | CGTCCTATCGGGTTCCCTTG | 6285 | SPBC1709.07_DN | ATCCGGTCAGTCTGTGCCAG |
| 6184 | SPBC16E9.14c_UP | CTGGCCATTCGCGACGTTG | 6286 | SPBC1709.09_UP | GTTTCCTGGGGTGAGGTCGC |
| 6185 | SPBC16E9.14c_DN | CGCACTCCTCGACCACGCTC | 6287 | SPBC1709.09_DN | ACCCCCCTCCCCCAACATAG |
| 6186 | SPBC16E9.15_UP | GGGATAGTCGGGCGGTTGGTC | 6288 | SPBC1709.10c_UP | GCCTTTTCCTCGCCGCTCTC |
| 6187 | SPBC16E9.15_DN | TTAACCCAGCCCGCCCCACT | 6289 | SPBC1709.10c_DN | ACCCGCGGCCGTCCTACTTTG |
| 6188 | SPBC16E9.17c_UP | ATACCATCCGCGGCCCTGAA | 6290 | SPBC1709.11c_UP | AACGTCGCCGAAACAGCACC |
| 6189 | SPBC16E9.17c_DN | AAGGGGGGGGGCAAGGACTAG | 6291 | SPBC1709.11c_DN | CACACGGGTGCATTCGCAAT |
| 6190 | SPBC16E9.19_UP | AGTCGCGTCACCATGTAGG | 6292 | SPBC1709.12_UP | CAAAGCCTCTCCACCCCCCT |
| 6191 | SPBC16E9.19_DN | CCTGCGTCACGAGCGTATGA | 6293 | SPBC1709.12_DN | GCGCGCACGTGAGGTACAAG |
| 6192 | SPBC16G5.02c_UP | CGCCTCGTCGCGCTTTGTTA | 6294 | SPBC1709.13c_UP | GAGGATATTTGGCGCTGGG |
| 6193 | SPBC16G5.02c_DN | ATGGCCCTCGATCACGTCAG | 6295 | SPBC1709.13c_DN | GCCCAGGTACCAATGCACAG |
| 6194 | SPBC16G5.03_UP | TCGCGGATTGATAACGTGGC | 6296 | SPBC1709.14_UP | GCCCCGGGTTATGGAAGCTT |
| 6195 | SPBC16G5.03_DN | GATAGCCACCCATTGCGCCC | 6297 | SPBC1709.14_DN | GCTGCCGCGCTGGGTAACAAC |
| 6196 | SPBC16G5.04_UP | TTTGCGCACCGGTATGCACC | 6298 | SPBC1709.15c_UP | CTGACACATCGCCGCAACG |
| 6197 | SPBC16G5.04_DN | CTAGGAGGGGACGAAGGGCA | 6299 | SPBC1709.15c_DN | CCTTGGCTTCGCCCGTCTCT |
| 6198 | SPBC16G5.05c_UP | AAGATCAAACCGCCACCCGA | 6300 | SPBC1709.16c_UP | GCCCCAGCGCCCACTATGTT |
| 6199 | SPBC16G5.05c_DN | TAGACCCCTCCGCGTTTGCG | 6301 | SPBC1709.16c_DN | TCTCGACACCACCAAAGCGC |
| 6200 | SPBC16G5.06_UP | CACGGTTCAGCATGGGTCGG | 6302 | SPBC1709.18_UP | TCGTTGACATGACTCCCCGG |
| 6201 | SPBC16G5.06_DN | CGCCCCCTTGTCGATGGTT | 6303 | SPBC1709.18_DN | GAAGGGTAGGCGGGTGTCC |
| 6202 | SPBC16G5.07c_UP | TTTGGCTTGGGAATGGGCGA | 6304 | SPBC1709.20_UP | ATACGCGGCCGAGTTGTACT |
| 6203 | SPBC16G5.07c_DN | CGTGGCGGAGCGGAGAAGAT | 6305 | SPBC1709.20_DN | GCTCAGTGCACCGGCTAGTT |
| 6204 | SPBC16G5.08_UP | AGACCGGAGCGAGGCGATTA | 6306 | SPBC1711.01c_UP | TAAATACCCGGGTGCCGCTG |
| 6205 | SPBC16G5.08_DN | ACCCAGTCCACCTGTCAAGG | 6307 | SPBC1711.01c_DN | TCGAGTGCACCCGTAGACAC |
| 6206 | SPBC16G5.09_UP | GACCCCTCCCGGCATTCGTT | 6308 | SPBC1711.03_UP | AGGCAAGCGGCATAGGGCAG |
| 6207 | SPBC16G5.09_DN | AGTGGGGCAGACGCGTGAAG | 6309 | SPBC1711.03_DN | TGTTGGAGCTCTTTGGCGGC |
| 6208 | SPBC16G5.10_UP | TTTCAGTTGGGCTGGACGGC | 6310 | SPBC1711.04_UP | CTAGGGATGGGAGCGGGCAG |
| 6209 | SPBC16G5.10_DN | CATCCGTCCCGCTCCGCACC | 6311 | SPBC1711.04_DN | AGGTGCGGGGAAGTGTTGG |
| 6210 | SPBC16G5.11c_UP | GGATCGAGTTTGCGGGGTTG | 6312 | SPBC1711.05_UP | GCCACCCTGCTTTGACCGCT |
| 6211 | SPBC16G5.11c_DN | ACCGGTAGCACGGAACGGCA | 6313 | SPBC1711.05_DN | AAAAATGCGAGGACGGGGGG |
| 6212 | SPBC16G5.12c_UP | ACCGCGGAAACGCCGTAGAGT | 6314 | SPBC1711.06_UP | CGCTTTCCCGGTCAGGTCCAA |
| 6213 | SPBC16G5.12c_DN | GCCCGGATCTCGCATAGCCTT | 6315 | SPBC1711.06_DN | CCAAGAGCAAGCGCATAACG |
| 6214 | SPBC16G5.13_UP | GGTGCCCCTTTAAATCGCC | 6316 | SPBC1711.07_UP | AACTTCTCGAATCCGGCACC |
| 6215 | SPBC16G5.13_DN | AAGGCCTGCGTAGCGACTGA | 6317 | SPBC1711.07_DN | ATAAACTCGCACGGACGCCG |
| 6216 | SPBC16G5.14c_UP | CGGGATCAAGAGAGGGGGCT | 6318 | SPBC1711.08_UP | CACCATTCACGTTCCGCCCT |
| 6217 | SPBC16G5.14c_DN | TTGCCCCGCCACTTGATCTT | 6319 | SPBC1711.08_DN | AACGGGGACAGGAACCATC |
| 6218 | SPBC16G5.15c_UP | GCACGAAAGATGCGCGCAC | 6320 | SPBC1711.09c_UP | CACCTAGGCGCGCTAAGGTT |
| 6219 | SPBC16G5.15c_DN | GGCGGGTCCAGTTTGGGGAT | 6321 | SPBC1711.09c_DN | AATCTTTTGTCGTGGGGCCG |
| 6220 | SPBC16G5.16_UP | ATCGTTGACAGAGGCGGGA | 6322 | SPBC1711.10c_UP | GGACCCAGGGCGTCGTGAAAG |
| 6221 | SPBC16G5.16_DN | GGCGGCCGAACGAAAAGTAC | 6323 | SPBC1711.10c_DN | GCTGGCTTAGGGGCGTGAGT |
| 6222 | SPBC16G5.17_UP | ATTCACTTCCGTGGGCGGCC | 6324 | SPBC1711.11_UP | ACTACCCGATCCGACCACCC |

FIG.38

| Sequence number | Name | Base sequence | Sequence number | Name | Base sequence |
|---|---|---|---|---|---|
| 6325 | SPBC1711.11_DN | AAGGTACACCGCCAGCCTC | 6427 | SPBC17D11.02c_DN | ACGTTTTGGGTTGGTTGGCC |
| 6326 | SPBC1711.12_UP | TTGTGGCCGTCCTTTCGTTG | 6428 | SPBC17D11.03c_UP | TACCAATTGAGGCGCCGCAA |
| 6327 | SPBC1711.12_DN | GGACGCGGGTGGGCTTAATT | 6429 | SPBC17D11.03c_DN | TGGGCACGCGAGGGTAACTG |
| 6328 | SPBC1711.13_UP | CGACCCTGCAAAGCCAAACA | 6430 | SPBC17D11.04c_UP | ACGGCCAATTTTCCCTGCAC |
| 6329 | SPBC1711.13_DN | GAGGGGCTAGTGCGGGTCTG | 6431 | SPBC17D11.04c_DN | AAACGCGCCAGCCACTCTTG |
| 6330 | SPBC1718.01_UP | GGGGCGCGATTTTTGTGACT | 6432 | SPBC17D11.05_UP | CCATAACTTGGCCCATGCCG |
| 6331 | SPBC1718.01_DN | ATAGGGCTGGCGAGGCGGAG | 6433 | SPBC17D11.05_DN | GGGCTCCGGCTCACGACTTAT |
| 6332 | SPBC1718.02_UP | CCCGCCACGGATCCATTCAG | 6434 | SPBC17D11.06_UP | GAGTCTTGGCTGGGTGGCTG |
| 6333 | SPBC1718.02_DN | CCACCGATGACCTGCGTTCC | 6435 | SPBC17D11.06_DN | CGCCCAACTCCCGCACTCTA |
| 6334 | SPBC1718.03_UP | GAGGTGCGGGGAGTTCAAG | 6436 | SPBC17D11.08_UP | CGTGGGCGTAACAATCCGGA |
| 6335 | SPBC1718.03_DN | GGGGGCGAGGGACGAGCTAT | 6437 | SPBC17D11.08_DN | TGAAACTTACCCCGGCGACG |
| 6336 | SPBC1718.06_UP | CTTGCGGATCCATTTGCCCG | 6438 | SPBC17F3.02_UP | TCACATCGCTGTAGAGGCCA |
| 6337 | SPBC1718.06_DN | CCAGATCTCGAGCAGCCACG | 6439 | SPBC17F3.02_DN | GCCAATCTAGCGCGGACCCA |
| 6338 | SPBC1718.07c_UP | GCGGGAAAGAGGGGCAGGAT | 6440 | SPBC17G9.02c_UP | TCGGGGCATTCTGGTGGGTG |
| 6339 | SPBC1718.07c_DN | CGGCTTCCCACCGACCTCCT | 6441 | SPBC17G9.02c_DN | CCAAAAAGCCCCTTCCCACC |
| 6340 | SPBC1734.05c_UP | TGCCCCTGCTGATTTTGTTC | 6442 | SPBC17G9.03c_UP | TACCCCGTGGTTTCTGCGGA |
| 6341 | SPBC1734.05c_DN | CAAGCGGGGGTACTCGGGCA | 6443 | SPBC17G9.03c_DN | AGGCGGCGGAACATACGTCA |
| 6342 | SPBC1734.06_UP | GCCAGCCGATATGTTCCCGT | 6444 | SPBC17G9.04c_UP | ATGTAACCGCGTACCGTGC |
| 6343 | SPBC1734.06_DN | TTGGGGCACGGCGGGTAAAT | 6445 | SPBC17G9.04c_DN | ACTACACGGGGCGCGTAAAT |
| 6344 | SPBC1734.07c_UP | TTTGGGGGCTGTGAGGCGAA | 6446 | SPBC17G9.05_UP | GACAAGACCCACACGCGGGA |
| 6345 | SPBC1734.07c_DN | CGAGCCCGCTATCACCACAA | 6447 | SPBC17G9.05_DN | TACGTGTGCCGCGTGGCTTT |
| 6346 | SPBC1734.08_UP | AAGGGGGCTTCGCGTGTCTT | 6448 | SPBC17G9.06c_UP | TCCATCTCGCTCACCATCCG |
| 6347 | SPBC1734.08_DN | GTTGGGGCACTTGAGCGAGC | 6449 | SPBC17G9.08c_DN | GCGGGAAGCGAACTGCGAAG |
| 6348 | SPBC1734.09_UP | GCCCCCTGGGACATTGTTGGA | 6450 | SPBC17G9.09_UP | CGCTGGGGATCCGATATGAA |
| 6349 | SPBC1734.09_DN | TGCCTCCGCTAGCGGCTCAAC | 6451 | SPBC17G9.09_DN | AATTGGAGTTTGGTGCGCGC |
| 6350 | SPBC1734.12c_UP | AAAAAGTGAAGCGCTCGGGG | 6452 | SPBC17G9.10_UP | CGGTCTGCCCGCCAGAAAGG |
| 6351 | SPBC1734.12c_DN | GCTCTGGTTGCGGTTGCCATA | 6453 | SPBC17G9.10_DN | CCCGCCATCACCCAGAATCC |
| 6352 | SPBC1734.13_UP | AGTCTCGTGCGCGGTTTCCC | 6454 | SPBC17G9.11c_UP | AAGCCCATCCGCAACCATGC |
| 6353 | SPBC1734.13_DN | GTAGCGGCCGCAGGGGAAAA | 6455 | SPBC17G9.11c_DN | CTGCTGCGGGGGCGCAAAATG |
| 6354 | SPBC1734.14c_UP | CGCCCAACCGCCCAAATGAAG | 6456 | SPBC17G9.12c_UP | GTCTCGGCACGCAAATCAGC |
| 6355 | SPBC1734.14c_DN | CCAACGCACAAACAAACCGC | 6457 | SPBC17G9.12c_DN | TACGGGGCGCACAATCTACG |
| 6356 | SPBC1734.15_UP | GAGTCAGGGATGGCGGTGGA | 6458 | SPBC1861.02_UP | GACCTCCGCCTGCTCCCACT |
| 6357 | SPBC1734.15_DN | ACCCGACCCTACGCTACCGC | 6459 | SPBC1861.02_DN | TCCCCTACCTGCCGGTTTTG |
| 6358 | SPBC1773.01_UP | GGACCCCGCAAGTTACGAAT | 6460 | SPBC1861.03_UP | ATCACCCTGCCACGCTCCAT |
| 6359 | SPBC1773.01_DN | GTCACTACGAAGGCCGGCCC | 6461 | SPBC1861.03_DN | ACCACCTCATGCCACGTCCG |
| 6360 | SPBC1773.02c_UP | TCCAGCCCGGTCATTATCCG | 6462 | SPBC1861.04c_UP | ATGAAGCGTGCCTGTAGCGC |
| 6361 | SPBC1773.02c_DN | CAATGTAATGACCGCGGCCG | 6463 | SPBC1861.04c_DN | TCCGACGCGTGTGATCAGGA |
| 6362 | SPBC1773.03c_UP | CGTCAGCTCCTATGCGGTCT | 6464 | SPBC1861.05_UP | AGAATGCGGCCGTACTGCGGA |
| 6363 | SPBC1773.03c_DN | CTGCCCGCTATGACCCGCAC | 6465 | SPBC1861.05_DN | AGACGCTCATTCCCCGCAG |
| 6364 | SPBC1773.04_UP | GGATCTACGTGGGTCGGGCC | 6466 | SPBC1861.06c_UP | TTCGGCGTCTCATGGGTTCC |
| 6365 | SPBC1773.04_DN | CACGGCGGAGGAATAGGAA | 6467 | SPBC1861.06c_DN | CCACCGCGCCTATTGAACCA |
| 6366 | SPBC1773.05c_UP | ATCCACCCCCAAACCCTGCC | 6468 | SPBC1861.07_UP | CGCTCCATCCAAACCGTCAA |
| 6367 | SPBC1773.05c_DN | TTCGGTTCGGTTCAATGGGC | 6469 | SPBC1861.07_DN | AGAAGCTGCATGTGGGCGCA |
| 6368 | SPBC1773.06c_UP | CGGGTTGGGAAAGTTGAGCG | 6470 | SPBC1861.08c_UP | ATGTTAGGGGGGCGTGGGT |
| 6369 | SPBC1773.06c_DN | TCTTCAGTCCCCCAGGCCGT | 6471 | SPBC1861.08c_DN | CAGCCCCAACGTCACTGCT |
| 6370 | SPBC1773.07c_UP | TGCTTCCCCCCGTCGCTAAC | 6472 | SPBC1861.09_UP | CTGCAATGGGGGTACTACC |
| 6371 | SPBC1773.07c_DN | CGGTCGTTTTCGTGCCCATT | 6473 | SPBC1861.09_DN | CTCAAATCCAACTCCCACCG |
| 6372 | SPBC1773.08c_UP | CAAGCAGATTACAGCGCGGC | 6474 | SPBC18A7.02c_UP | CTCGGCAGCACACGCCCTTCA |
| 6373 | SPBC1773.08c_DN | GCGAAAAACGACCGGGGGAG | 6475 | SPBC18A7.02c_DN | ATAAGAGTCGTCGCCGGGGG |
| 6374 | SPBC1773.09c_UP | AAATGGTGCGATGGCGTGCT | 6476 | SPBC18E5.04_UP | CTTCGGGAGGCAATAGGGGG |
| 6375 | SPBC1773.09c_DN | TTTATCGCCTGCCCAATCCC | 6477 | SPBC18E5.04_DN | CTCTGGGGGGCATATGTCCC |
| 6376 | SPBC1773.10c_UP | ACATCCGTGGGCCCTTTGGC | 6478 | SPBC18E5.05c_UP | ATAGCTGATCTGCGGGCGG |
| 6377 | SPBC1773.10c_DN | TTTCGGCGCTCCATGAGTCA | 6479 | SPBC18E5.05c_DN | ATGGGCGCACAACTCGAAGC |
| 6378 | SPBC1773.12_UP | CAAAAGTGTGCCCGGCTGCA | 6480 | SPBC18E5.06_UP | AAACCCGGCCCTGAACCATG |
| 6379 | SPBC1773.12_DN | CGAGCCGTCCGTGATGTCCCA | 6481 | SPBC18E5.06_DN | TTGGCGGTTGCTCTTTGGGA |
| 6380 | SPBC1773.13_UP | TCCAAACGGGCCATCACGAT | 6482 | SPBC18E5.07_UP | GCGCGTGTTTGCTTTGGGG |
| 6381 | SPBC1773.13_DN | AAGTGGTGCGTGCGCGTCTC | 6483 | SPBC18E5.07_DN | CGGGGAATAGGAAGGAGCGG |
| 6382 | SPBC1773.14_UP | TCCAATACCTGCTCGGGCCT | 6484 | SPBC18E5.08_UP | AGCCTGCGTGGGAATAAGCCG |
| 6383 | SPBC1773.14_DN | CATCAATTCCCGGCCAGAA | 6485 | SPBC18E5.08_DN | GATCTGGAGGCGCTGGTTGC |
| 6384 | SPBC1773.15_UP | TGCCAGGTGATGTCGGATCC | 6486 | SPBC18E5.09c_UP | CGGGCCCACGCCCTTGATCAT |
| 6385 | SPBC1773.15_DN | GTCGGCTCTGCTGCTTTTGG | 6487 | SPBC18E5.09c_DN | CGGCTTCGGTCGGGTTGATG |
| 6386 | SPBC1773.16c_UP | CCGGGAGCTGTATGGATGGC | 6488 | SPBC18E5.10_UP | TGAAGGCTGATGGGCGGTCC |
| 6387 | SPBC1773.16c_DN | GCGCCGTCTTAAGCGCCATGT | 6489 | SPBC18E5.10_DN | GGGTTCTTGTTGTCCGGGGG |
| 6388 | SPBC1778.02_UP | TCCTCGACTCACATTGCGCC | 6490 | SPBC18E5.14c_UP | ACACCACCAGGCTGAACCGA |
| 6389 | SPBC1778.02_DN | GCCCTGCGTCCCCTAACACC | 6491 | SPBC18E5.14c_DN | AGGTCGGACTCATGTCACGC |
| 6390 | SPBC1778.03c_UP | TGCTGTGTAGTGGGCGACGG | 6492 | SPBC18H10.03_UP | TTGCCCTGCCAGCTAGTCTGG |
| 6391 | SPBC1778.03c_DN | TCGACCCTGCCCAACCAAGA | 6493 | SPBC18H10.03_DN | CACGCGATCTAGGGTGAGCA |
| 6392 | SPBC1778.04_UP | CGAAGTGCGGGCAGCCAGGC | 6494 | SPBC18H10.04c_UP | CCGCAACCCCATGAATGATG |
| 6393 | SPBC1778.04_DN | TTTCCGGCTGCAAAAGCTCT | 6495 | SPBC18H10.04c_DN | GCCCTGGGGTTGGGGTTAAG |
| 6394 | SPBC1778.05c_UP | CTCCACCAGAAACGCGCAGC | 6496 | SPBC18H10.05_UP | CCACTCCCACGTCTGCCCAT |
| 6395 | SPBC1778.05c_DN | TACTCTCGCCGCGCTGATCC | 6497 | SPBC18H10.05_DN | TGCGCCTCGGTTCTTCTCC |
| 6396 | SPBC1778.06_UP | GGGTCTGGTTCCGGGGTCGA | 6498 | SPBC18H10.06c_UP | TGGTGAAGAGGGTACGCCCG |
| 6397 | SPBC1778.06c_DN | CCGCGCTGGGCCAATTCTTC | 6499 | SPBC18H10.06c_DN | GAGCAAATGAACGCGAGGCG |
| 6398 | SPBC1778.07_UP | TTCCGGTGCTCGGACCATAG | 6500 | SPBC18H10.07_UP | CCAAAGACTCTGCTCCCGAC |
| 6399 | SPBC1778.07_DN | AACGTAGGAGAGGGCCGGC | 6501 | SPBC18H10.07_DN | ACGCACAATCCGAAACCCCC |
| 6400 | SPBC1778.08c_UP | AACCGTTCGCTCCCATCCTG | 6502 | SPBC18H10.08_UP | GCGTTGTTCCGGAGGCGTAG |
| 6401 | SPBC1778.08c_DN | CCCCTCCGCGGATAGCTCCAC | 6503 | SPBC18H10.08c_DN | GCGGGGAGGACCAAGAATGA |
| 6402 | SPBC1778.09_UP | CCGAGTCACGCCCACGAGTC | 6504 | SPBC18H10.09_UP | TGGTAGGAGCGTGGGGGTGA |
| 6403 | SPBC1778.09_DN | TCGATTAGCTGGCCGGTCG | 6505 | SPBC18H10.09_DN | TGGGCAGATTTGGGCGAGCT |
| 6404 | SPBC17A3.02_UP | TAACACCCTCTGGCGCCTGG | 6506 | SPBC18H10.10c_UP | CCTGTTCGCCCCTTGCCTCC |
| 6405 | SPBC17A3.02_DN | TGAGGATAACCGGTGGGCGT | 6507 | SPBC18H10.10c_DN | CGGCGGGATGATGGGATGAC |
| 6406 | SPBC17A3.03c_UP | CAAGCAGGCTGTGTGCGGGGC | 6508 | SPBC18H10.11c_UP | TCCGCGCGTTGGCCCTATTA |
| 6407 | SPBC17A3.03c_DN | CGGGCAGGAAGGGAAGGTCG | 6509 | SPBC18H10.11c_DN | GCGGGGGCTTGGATTGGTGT |
| 6408 | SPBC17A3.06_UP | TCCAGGGCGGATAGCTCCAC | 6510 | SPBC18H10.13_UP | CGCGACGTTTACCCAGTTCT |
| 6409 | SPBC17A3.06_DN | TAGCGCAAGCGCCCTCAAAAA | 6511 | SPBC18H10.13_DN | AGAACGCGACAGGAACGCA |
| 6410 | SPBC17A3.07_UP | AGCGGACACGTAGTGCTGGAT | 6512 | SPBC18H10.15_UP | ACTGGGGCCGGAGGATTACG |
| 6411 | SPBC17A3.07_DN | TACGCCCGTGCCGCTATCAACA | 6513 | SPBC18H10.15_DN | CTCCAAAGCACTGCCGCCGG |
| 6412 | SPBC17A3.08_UP | AGCAGCGCGACAGCGTTGGT | 6514 | SPBC18H10.16_UP | TGTCCTACGCCCTTTCGCCT |
| 6413 | SPBC17A3.08_DN | GTAAGCGGGCAGCAAGGTCG | 6515 | SPBC18H10.16_DN | TTTTTTTCGGCTTGCGGCT |
| 6414 | SPBC17A3.10_UP | GCAGCGTGCCCCTATCTCT | 6516 | SPBC18H10.18c_UP | GAGCGTGGGCGGAGTGGATA |
| 6415 | SPBC17A3.10_DN | CTTTCCCCTATCGGCGGTGC | 6517 | SPBC18H10.18c_DN | TAGCCCCAATCGCGAACACG |
| 6416 | SPBC17D1.02_UP | ACTAAACCCGCCGCACTCGA | 6518 | SPBC18H10.19_UP | GGGCATGCGATCGAAGGGAG |
| 6417 | SPBC17D1.02_DN | GACTTTCGCCTCGGCGGGTT | 6519 | SPBC18H10.19_DN | ACAATGGGCGCGCAGACAGC |
| 6418 | SPBC17D1.03c_UP | GGCAGATGTGGCGGTGACGT | 6520 | SPBC18H10.20c_UP | TAGCTTGTCGGGAGGGGCGT |
| 6419 | SPBC17D1.03c_DN | ACAAATCCGCTCCGTGCGT | 6521 | SPBC18H10.20c_DN | ACGTGGCGGGGTTTTCCTC |
| 6420 | SPBC17D1.05_UP | TTTCCCGGTGCCGGTTTGA | 6522 | SPBC1921.03c_UP | CCTTGGCTCCCATCGCTTTG |
| 6421 | SPBC17D1.05_DN | TTGGTGGCGTTTGGGCATCG | 6523 | SPBC1921.03c_DN | GAGGGTCGTGGGGGTGCTCT |
| 6422 | SPBC17D1.06_UP | GTCGGGCGTGCCTGGGTAAT | 6524 | SPBC1921.04c_UP | CCAGCAACCGCCCAAATAG |
| 6423 | SPBC17D1.06_DN | CCCTTTCTTGCCATGCCCCC | 6525 | SPBC1921.04c_DN | CAATGACGGCTGGGCAAGAA |
| 6424 | SPBC17D1.07c_UP | ACATCAAGGCCCCAACAGGG | 6526 | SPBC1921.05_UP | ACCCGTTTGCATCCCTCCCT |
| 6425 | SPBC17D1.07c_DN | TCACCTTGACCTCGCTCCC | 6527 | SPBC1921.05_DN | TGCTCGCCAATTGATCGTCC |
| 6426 | SPBC17D11.02c_UP | AGGTCTCGAAAGCGCGCGT | 6528 | SPBC1921.06c_UP | CTCCGGCACGCAGAACGTCC |

FIG. 39

| Sequence number | Name | Base sequence |
|---|---|---|
| 6529 | SPBC1921.06c_DN | TACAAGTCGTGGTCGGGGCC |
| 6530 | SPBC19C2.02_UP | GGGCAGCGGGAGCAATTAA |
| 6531 | SPBC19C2.02_DN | GGCATGACCCTAACTCGGCG |
| 6532 | SPBC19C2.03_UP | CCTAAGGGGCGAGACCGGTC |
| 6533 | SPBC19C2.03_DN | AGCGCGGCCATCCTAGACAT |
| 6534 | SPBC19C2.04c_UP | CCTCCACCCCACACTCCGTT |
| 6535 | SPBC19C2.04c_DN | GGTAATTGATGGCGGGCTGG |
| 6536 | SPBC19C2.05_UP | GACTTATGGACGGCACCGCG |
| 6537 | SPBC19C2.05_DN | CCTTGGTGGGGGGTCTGTCA |
| 6538 | SPBC19C2.06c_UP | TGCCGCATAGCAACGCGAACA |
| 6539 | SPBC19C2.06c_DN | GCTTTGCTTGGCGGGGTTTA |
| 6540 | SPBC19C2.08_UP | CAGCCACAGTAAAGCGCCGA |
| 6541 | SPBC19C2.08_DN | CACACTCGGGCGCCTTTAA |
| 6542 | SPBC19C2.09_UP | ACCCCGCTTTCAATCCGTCG |
| 6543 | SPBC19C2.09_DN | AACTCCTCCCGGTCTCGCAA |
| 6544 | SPBC19C2.10_UP | AGCCCAAAGGTAGCACCCGC |
| 6545 | SPBC19C2.10_DN | TTCTGATAGGGGAGGCGCA |
| 6546 | SPBC19C2.13c_UP | GTTCATGCCCGTTTCGCCCA |
| 6547 | SPBC19C2.13c_DN | ACCTCCCCTCAAGTTCCGCC |
| 6548 | SPBC19C2.14_UP | TCCACGCAAAACCTCGCCTT |
| 6549 | SPBC19C2.14_DN | CGGAATACGCTGGGAGTGCA |
| 6550 | SPBC19C7.03_UP | AGTGTTGCGAGGCGGAGGAA |
| 6551 | SPBC19C7.03_DN | TCACCTTTTGTGGGGCGGT |
| 6552 | SPBC19C7.04c_UP | TTACCGCCGGCCACTCTCA |
| 6553 | SPBC19C7.04c_DN | TTTGTCCATTGCCCGAGCCT |
| 6554 | SPBC19C7.05_UP | GCGAGTAAAGCCCGATTGG |
| 6555 | SPBC19C7.05_DN | GGAGCTATGGCGACTTGGGG |
| 6556 | SPBC19C7.06_UP | CCAGCCACGTTTTCCCCCTT |
| 6557 | SPBC19C7.06_DN | CACGCGCACCTTTCCACACT |
| 6558 | SPBC19C7.07c_UP | TTCTCGCTGCTCGCTTCCGT |
| 6559 | SPBC19C7.07c_DN | CTCGGCTCCCTCCCGTGTTA |
| 6560 | SPBC19C7.08c_UP | ACGGTGATAGAGACGGGCGC |
| 6561 | SPBC19C7.08c_DN | TGCCCGGACGAGGTAATGGA |
| 6562 | SPBC19C7.09c_UP | CTGCCTGCCCCACTCTCGGT |
| 6563 | SPBC19C7.09c_DN | GCTGCGTGGAGGGGGGTAGT |
| 6564 | SPBC19C7.10_UP | GTGTGCGTGCTGGGGATGTG |
| 6565 | SPBC19C7.10_DN | GAGGCAACGGACGCGAAGAA |
| 6566 | SPBC19C7.11_UP | GAAGCGGCGAGACGACAGGC |
| 6567 | SPBC19C7.11_DN | AAGTCGAACTGGAACGAGGC |
| 6568 | SPBC19C7.12c_UP | CCCGATACCCCCCCACGTCT |
| 6569 | SPBC19C7.12c_DN | TCCGCCCCCAAACCCTACTC |
| 6570 | SPBC19F5.02c_UP | ATGATGAAGGCCCACCCGCC |
| 6571 | SPBC19F5.02c_DN | ACCTGTCACCCGCTGCCCTC |
| 6572 | SPBC19F5.03_UP | GCCAATATGTCCCCTCCCCC |
| 6573 | SPBC19F5.03_DN | GGACCGCGAGTATGCATGCG |
| 6574 | SPBC19F5.04_UP | CGTTCCGCTGCTCGTGGCTG |
| 6575 | SPBC19F5.04_DN | ACTGATATGCCCCCGTCCCC |
| 6576 | SPBC19F8.02_UP | GGCAACAAACGCGACATGGC |
| 6577 | SPBC19F8.02_DN | CCTGCTGTTCCGTCCCACA |
| 6578 | SPBC19F8.03c_UP | CGGCTAAGCCGTTTGGCGAA |
| 6579 | SPBC19F8.03c_DN | CGATTAATGCCCCGTTGCCA |
| 6580 | SPBC19F8.04c_UP | AATTGAACAGACCCCCGCC |
| 6581 | SPBC19F8.04c_DN | TTTCCCGACACAGACCCGAG |
| 6582 | SPBC19F8.06c_UP | TCCACCGCCACTCCAGCAAT |
| 6583 | SPBC19F8.06c_DN | GGGGGTTGTGGCTTTGCTGC |
| 6584 | SPBC19F8.07_UP | CCGCAAACAAGGACCAGGGG |
| 6585 | SPBC19F8.07_DN | GCCATCTCGTGCCGCGTTAA |
| 6586 | SPBC19G7.02_UP | CGTTAGGACTGCGTGGGCTG |
| 6587 | SPBC19G7.02_DN | TGGGAGCGGCATGTTGGAAG |
| 6588 | SPBC19G7.03c_UP | CCAAAGCAGCAAAGGGCAC |
| 6589 | SPBC19G7.03c_DN | ATGGGCAGTTGCTGAGCGC |
| 6590 | SPBC19G7.04_UP | TCACTCATCCCAGCACGCCG |
| 6591 | SPBC19G7.04_DN | CAAGACCAGGGGCCGTTCAC |
| 6592 | SPBC19G7.05c_UP | GTGTTTTGCGGCTCCAGGGT |
| 6593 | SPBC19G7.05c_DN | CCCATACGCACCTCCGACGG |
| 6594 | SPBC19G7.06_UP | GACGACGGTGTACGGGTAGA |
| 6595 | SPBC19G7.06_DN | AGAAGGTGGGCAACGGCAAA |
| 6596 | SPBC19G7.07c_UP | CGACGCAACAGGGGAACAG |
| 6597 | SPBC19G7.07c_DN | CCCGTGGTCTTGGCGTGCTA |
| 6598 | SPBC19G7.08c_UP | ATCACGCTCCCAAGATCCCG |
| 6599 | SPBC19G7.08c_DN | CCCCAAATCGACGCTCCTG |
| 6600 | SPBC19G7.09_UP | AACTTGGTGCGTGCCGGGAC |
| 6601 | SPBC19G7.09_DN | CGGCAAATCGGCTCCAGTGT |
| 6602 | SPBC19G7.10c_UP | AAGGTCCCAGCTCCCCGAAG |
| 6603 | SPBC19G7.10c_DN | CAGGAAACCCGACACGATG |
| 6604 | SPBC19G7.13_UP | TCCAGCCCCTGTTGCCTCCC |
| 6605 | SPBC19G7.13_DN | GCCGCGAAGTGGACGCTTAT |
| 6606 | SPBC19G7.15_UP | GCAAGTCATCGGGCATTACG |
| 6607 | SPBC19G7.16_UP | CATGCACACTAGGCCACGGA |
| 6608 | SPBC19G7.17_UP | ATGAGACCTAACCGCCCCCG |
| 6609 | SPBC19G7.17_DN | CCTTCCAGCCCCTGACGATG |
| 6610 | SPBC1A4.03c_UP | AACCGAAAGGAAGCCGGAG |
| 6611 | SPBC1A4.03c_DN | TGCCCTAGGTGCTAGATGCG |
| 6612 | SPBC1A4.04_UP | TCCGGGCCTTTTCGATCTTG |
| 6613 | SPBC1A4.04_DN | AGGTGCGCGGTTTCCATGAT |
| 6614 | SPBC1A4.05_UP | TTTTTGCAGGAGGGCGCTTT |
| 6615 | SPBC1A4.05_DN | CGGGTCTTAGGCGTGGGGA |
| 6616 | SPBC1A4.06c_UP | GATTGAGTGGGGGTGGCGAC |
| 6617 | SPBC1A4.06c_DN | TGCAAAGGGATCCCGGGAGG |
| 6618 | SPBC1A4.07c_UP | CAGTTCACGATGGGCGAGCA |
| 6619 | SPBC1A4.07c_DN | TCCCGCATCCCCTTGCACAT |
| 6620 | SPBC1A4.08c_UP | CGCGTGGTGGAGTTCTTTGT |
| 6621 | SPBC1A4.08c_DN | GTCGGGGATGTTCGGGATTG |
| 6622 | SPBC1A4.11c_UP | AGACGGCCTTTGTTGCTGA |
| 6623 | SPBC1A4.11c_DN | AACATTCGAAAGCGCCCCCG |
| 6624 | SPBC1D7.01_UP | CGTGATCCGGAAGCAATCCG |
| 6625 | SPBC1D7.01_DN | GCCCTGTCTTGACTTCCGCG |
| 6626 | SPBC1D7.03_UP | CATCGGGTAGAAGGCGGCTG |
| 6627 | SPBC1D7.03_DN | GCCGTTCCTGCCCAATCCATC |
| 6628 | SPBC1D7.04_UP | GACGCCCCCCAAAGATAGG |
| 6629 | SPBC1D7.04_DN | GAAAGCCCAAAGCTCACCCG |
| 6630 | SPBC1E8.02_UP | ATTGCCCCCATAGTCCGCCC |
| 6631 | SPBC1E8.02_DN | TTAGGCGGGATTGGCGGAAA |
| 6632 | SPBC1E8.03c_UP | GTCGCTCGTGGGGGTCAAT |
| 6633 | SPBC1E8.03c_DN | GCAAGGAAGGAGGGGGGGTG |
| 6634 | SPBC20F10.02c_UP | AACATCCCGCCCCACTGAAG |
| 6635 | SPBC20F10.02c_DN | ACCTTCGCGGCCCCTTGTTG |
| 6636 | SPBC20F10.03_UP | TAAACCGCCGCAAAACCGCA |
| 6637 | SPBC20F10.03_DN | TTGTTGTTCTGGTCGGGCCC |
| 6638 | SPBC20F10.05_UP | CTGTTGCCCGATTAGCCCGA |
| 6639 | SPBC20F10.05_DN | CACGTCGAGGCCAATACCGC |
| 6640 | SPBC20F10.06_UP | TGGCGACCGGGATGAACTCA |
| 6641 | SPBC20F10.06_DN | ATGCGAAACCGATGAACGC |
| 6642 | SPBC20F10.07_UP | ACGGGCGAGGAACGAACGAC |
| 6643 | SPBC20F10.07_DN | CTGCGGGTGAACTTTTGGCG |
| 6644 | SPBC20F10.08c_UP | GCAGGTCGACGACATCGCGT |
| 6645 | SPBC20F10.08c_DN | GGGCTGTTGGGGCGACTGAT |
| 6646 | SPBC20F10.10_UP | GATGCGGGGTGCCAAGGAGA |
| 6647 | SPBC20F10.10_DN | CCCATCCGCCCACCCAAAGT |
| 6648 | SPBC21.01_UP | CGAGATCAGGCGCCCACAAC |
| 6649 | SPBC21.01_DN | AGCCATACACCCGACGACCG |
| 6650 | SPBC21.02_UP | CCTCGAATCCGCAAAGACA |
| 6651 | SPBC21.02_DN | TGCGATGCCGTTTCAGGTTG |
| 6652 | SPBC21.03c_UP | TCCGCTCCCCCATCCTTAAG |
| 6653 | SPBC21.03c_DN | TTGGGAAGCCGACGACGAAG |
| 6654 | SPBC21.04_UP | CGGCAGAGGTACAGCGGAGG |
| 6655 | SPBC21.04_DN | AGACTTCCCCATGCCCGCG |
| 6656 | SPBC21.05c_UP | CCGCGCCACGACTAAAGGCT |
| 6657 | SPBC21.05c_DN | CCACAATCGGACGGAGCAT |
| 6658 | SPBC21.06c_UP | ACACTGGCGGAGGAGCATT |
| 6659 | SPBC21.06c_DN | GCCGGGACTGAAGGGTGCAT |
| 6660 | SPBC21.07c_UP | CCCGGTCGTAAGTGGCATGC |
| 6661 | SPBC21.07c_DN | CGACGCTAGAAGGATAGCGA |
| 6662 | SPBC211.02c_UP | CGGCGGCAATTAATACGACA |
| 6663 | SPBC211.02c_DN | CAAGCGCACAAAAGGGAACG |
| 6664 | SPBC211.03c_UP | AGGGAGTATGGCCACGCGAC |
| 6665 | SPBC211.03c_DN | GCCCCGCATTTTCATTCTCG |
| 6666 | SPBC211.04c_UP | AGCTCCCCGTGCTTAACCCT |
| 6667 | SPBC211.04c_DN | TTCACCCCGGCCACCTGCAG |
| 6668 | SPBC211.06_UP | GTTGGCAGGGAGCGCGTTCT |
| 6669 | SPBC211.06_DN | TGGTGCCCTTTCGGTTCGCT |
| 6670 | SPBC211.07c_UP | ACCCCCGACAGAGCAACACC |
| 6671 | SPBC211.07c_DN | TGCCCACACATCGTCCCAAT |
| 6672 | SPBC211.08c_UP | GGCTCTTGCGGCTTTTGCCT |
| 6673 | SPBC211.08c_DN | CAAAAGGACACGGAGCCCCA |
| 6674 | SPBC215.02_UP | AACCCAGCCCAAAGTCACCC |
| 6675 | SPBC215.02_DN | GGGGGCGTGGAGGACTATG |
| 6676 | SPBC215.03c_UP | GAGACGCACATTCGAGCAAA |
| 6677 | SPBC215.03c_DN | TGAGGGCTGGTGATTTGGCA |
| 6678 | SPBC215.04_UP | GTCGTAACCGTCCACCACT |
| 6679 | SPBC215.04_DN | ATCGTTGTCGGCAGTGCCTG |
| 6680 | SPBC215.05_UP | AAGAGGAGGCGGAGCGAGGC |
| 6681 | SPBC215.05_DN | TCCCCCGTTATTCATCCGCC |
| 6682 | SPBC215.06_UP | TGAATCGTGAGCTGCGCGAA |
| 6683 | SPBC215.06c_DN | CGGATAAGCCCGCGAGAGCA |
| 6684 | SPBC215.07c_UP | GTGCTGCTTGCGGCTGCTGT |
| 6685 | SPBC215.07c_DN | GAGGAGCGCCCCCACGAGAT |
| 6686 | SPBC215.08c_UP | TGCCGGCGAGAGGGAGTAAT |
| 6687 | SPBC215.08c_DN | CAGACGCACCCATATCCCGG |
| 6688 | SPBC215.09c_UP | TTGGGCGCACCCGTAGGATA |
| 6689 | SPBC215.09c_DN | TGTGGTGCCCCGTAAGTGGA |
| 6690 | SPBC215.10_UP | CCTCAGTGCCATTCCCCCCA |
| 6691 | SPBC215.10_DN | AACCGTGGGTCGATGCGTTC |
| 6692 | SPBC215.11c_UP | TCCACACATGCAAGCCCACG |
| 6693 | SPBC215.11c_DN | CACGACCCCAGCCGCAAGAT |
| 6694 | SPBC215.13_UP | GAACGTTGGGCGCGGTAAAA |
| 6695 | SPBC215.13_DN | AACACCCTTCCAGCCACCGC |
| 6696 | SPBC215.14c_UP | AGCCATACAGGGGGGGGAAG |
| 6697 | SPBC215.14c_DN | TCCCCTTTCACCCGAGCCAG |
| 6698 | SPBC216.02_UP | CGGGAGGGCTGGGATCGAAG |
| 6699 | SPBC216.02_DN | AGTCCCGTCTGCATAGCGCG |
| 6700 | SPBC216.03_UP | TCGGGATATTTGGCAGCGTG |
| 6701 | SPBC216.03_DN | ACAAGAGCACCCCGGAACGA |
| 6702 | SPBC216.04c_UP | CGGCGTCGCGTATAGGCAGA |
| 6703 | SPBC216.04c_DN | GCGACGCTACAACATCGGGA |
| 6704 | SPBC216.05_UP | CAGAGAGATGTGCCCCCCG |
| 6705 | SPBC216.05_DN | GGTACGTCCGCTCTCGCCGT |
| 6706 | SPBC216.06c_UP | TTTGCTCCGCCACCGTCCAC |
| 6707 | SPBC216.06c_DN | AAGCAAACGAGAGCCGAGCG |
| 6708 | SPBC21B10.02_UP | CAGCCCCACCCGAGAAGAAC |
| 6709 | SPBC21B10.02_DN | GCGGGGAACGGAATAGACGG |
| 6710 | SPBC21B10.03c_UP | GTCGTGTAGGATCCGGCCGA |
| 6711 | SPBC21B10.03c_DN | TTCTCTGGACGGGCCGTGAT |
| 6712 | SPBC21B10.04c_UP | CCCGAACCGCCAAACCTGGG |
| 6713 | SPBC21B10.04c_DN | CCGCACGCCGACACTCTCAC |
| 6714 | SPBC21B10.05c_UP | AGAGGCCGTGGCGGATGAGTC |
| 6715 | SPBC21B10.05c_DN | CTTGCTCGCTGCACGGTTCC |
| 6716 | SPBC21B10.06c_UP | CGGGATCATTTGGGCCTTTG |
| 6717 | SPBC21B10.06c_DN | ACCTGTACGCCCCACCTCGA |
| 6718 | SPBC21B10.07_UP | CGCGAGAACGAGCCAACAGC |
| 6719 | SPBC21B10.07_DN | TCAGGCAGGCACACGGACAT |
| 6720 | SPBC21B10.09_UP | TCTGCCTCGCCTCAGCCACC |
| 6721 | SPBC21B10.09_DN | GCAAGCGGAGACGGGAACGA |
| 6722 | SPBC21B10.10_UP | CACCCAATCCCAGCAGCAG |
| 6723 | SPBC21B10.10_DN | AACGCCGAAAGGACGGGACA |
| 6724 | SPBC21B10.11_UP | CAACTAATAGGGCCCGTGCCA |
| 6725 | SPBC21B10.11_DN | TCCGGGCTGCGTACTCACTG |
| 6726 | SPBC21B10.12_UP | CCCCGAACGAATTAGACCGC |
| 6727 | SPBC21B10.12_DN | ACGCCCCTCGAGCACATGTG |
| 6728 | SPBC21B10.13c_UP | TCCCAGGTCATCCCCGTTGA |
| 6729 | SPBC21B10.13c_DN | CGGCGCGTAGCGTAAACGAT |
| 6730 | SPBC21C3.02c_UP | CTTTCGGTTGCGGAATTCGG |
| 6731 | SPBC21C3.02c_DN | TGGCGTTTTGGGTCGGTTCA |
| 6732 | SPBC21C3.03_UP | CCGTGCCCCCATCAGCTTA |

FIG.40

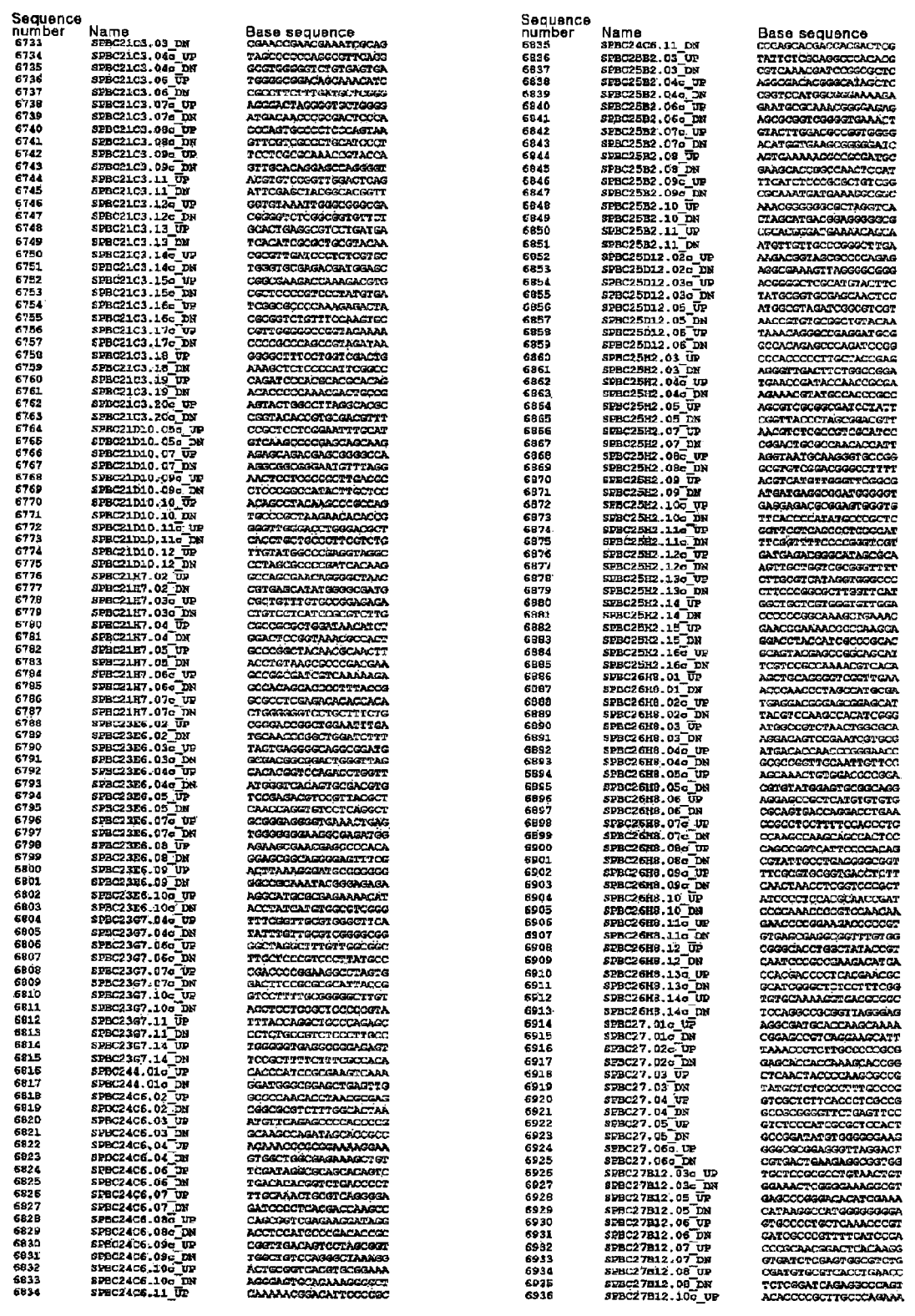

| Sequence number | Name | Base sequence |
|---|---|---|
| 6733 | SPBC21C3.03_DN | CGAACCGAACGAAATCGCAG |
| 6734 | SPBC21C3.04c_UP | TAGCCCCCCAGGCGTTCAGG |
| 6735 | SPBC21C3.04c_DN | GCGTGGGGTCTGTGAGTGA |
| 6736 | SPBC21C3.05_UP | TGGGGCGGACAGCAAACATC |
| 6737 | SPBC21C3.06_DN | CGCCTTCTTTGATGCTCGGG |
| 6738 | SPBC21C3.07c_UP | AGGGACTAGGGGTGCTGGGG |
| 6739 | SPBC21C3.07c_DN | ATGACAACCCGCGACTCCCA |
| 6740 | SPBC21C3.08c_UP | CCCAGTGCCCCTCCCAGTAA |
| 6741 | SPBC21C3.08c_DN | GTTCGTCGCCCTGCATCCCT |
| 6742 | SPBC21C3.09c_UP | TCCTCGCGCAAACCGTACCA |
| 6743 | SPBC21C3.09c_DN | GTTGCACAGGAGCCAGGGGT |
| 6744 | SPBC21C3.11_UP | ACGTGTCCGGTTGGACTCAG |
| 6745 | SPBC21C3.11_DN | ATTCGAGCTACGGCACGGTT |
| 6746 | SPBC21C3.12c_UP | GGTGTAAATTGGGCGGGCGA |
| 6747 | SPBC21C3.12c_DN | CGGGGTCTCGGCGGTGTTCT |
| 6748 | SPBC21C3.13_UP | GCACTGAGGCGTCCTGATGA |
| 6749 | SPBC21C3.13_DN | TCACATCGCGCTGCGTACAA |
| 6750 | SPBC21C3.14c_UP | CGCGTTGATCCCTCTCGTGC |
| 6751 | SPBC21C3.14c_DN | TGGGTGCGAGACGATGGAGC |
| 6752 | SPBC21C3.15c_UP | CGGCGAAGACCAAAGACGTG |
| 6753 | SPBC21C3.15c_DN | CGCTCCCCGTCCCTATGTGA |
| 6754 | SPBC21C3.16c_UP | TCGGCGCCCCAAAGAGACTA |
| 6755 | SPBC21C3.16c_DN | CGCGGTCTGTTTCCAAGTGC |
| 6756 | SPBC21C3.17c_UP | CGTTGGGGGCCCGTAGAAAA |
| 6757 | SPBC21C3.17c_DN | CCCCGCCCAGCCGTAGATAA |
| 6758 | SPBC21C3.18_UP | GGGGCTTTCCTGGTCGACTG |
| 6759 | SPBC21C3.18_DN | AAAGCTCTCCCCATTCGGCC |
| 6760 | SPBC21C3.19_UP | CAGATCCCACGCACGCACAG |
| 6761 | SPBC21C3.19_DN | ACACCCCCAAACGACTGCCC |
| 6762 | SPBC21C3.20c_UP | AGTACTGGCCTTAGGCACGC |
| 6763 | SPBC21C3.20c_DN | CGGTACACCGTGCGACGTTT |
| 6764 | SPBC21D10.05c_UP | CCGCTCCTCGGAATTTGCAT |
| 6765 | SPBC21D10.05c_DN | GTCAAGCCCCGAGCAGCAAG |
| 6766 | SPBC21D10.07_UP | AGAGCAGACGAGCGGGGCCA |
| 6767 | SPBC21D10.07_DN | AGGCGGCGGGAATGTTTAGG |
| 6768 | SPBC21D10.09c_UP | AACTCCTCCCCCCTTGACCC |
| 6769 | SPBC21D10.09c_DN | CTCCCGGCCATACTTGCTCC |
| 6770 | SPBC21D10.10_UP | ACAGCCTACAAGCCCGCCAG |
| 6771 | SPBC21D10.10_DN | TGCCCGCTAAGAACACACCG |
| 6772 | SPBC21D10.11c_UP | GGGTTGGGACCTGGGACGCT |
| 6773 | SPBC21D10.11c_DN | CACCTGCTGCCCTTCGTCTG |
| 6774 | SPBC21D10.12_UP | TTGTATGGCCCGAGGTAGGC |
| 6775 | SPBC21D10.12_DN | CCTAGCGCCCCGATCACAAG |
| 6776 | SPBC21H7.02_UP | GCCAGCGAACAGGGGCTAAC |
| 6777 | SPBC21H7.02_DN | CGTGAGCATATGGGGCGATG |
| 6778 | SPBC21H7.03c_UP | CGCTGTTTGTGCCGGAGAGA |
| 6779 | SPBC21H7.03c_DN | CTGTCCTCATCCGCGTCTTG |
| 6780 | SPBC21H7.04_UP | CGCCGCGCTGGATAACATCT |
| 6781 | SPBC21H7.04_DN | GGACTCCGGTAAACGCCACT |
| 6782 | SPBC21H7.05_UP | GCCCGGCTACAACGCAACTT |
| 6783 | SPBC21H7.05_DN | ACCTGTAAGCGCCCGACGAA |
| 6784 | SPBC21H7.06c_UP | GCCGGCGATCGTCAAAAAGA |
| 6785 | SPBC21H7.06c_DN | GCCACAGCACCCCTTTACCG |
| 6786 | SPBC21H7.07c_UP | GCGCCTCGAGACACACCACA |
| 6787 | SPBC21H7.07c_DN | CTGGGGGGTCCTGCTTTCTG |
| 6788 | SPBC23E6.02_UP | CGGGACCGGCTGGAATTTGA |
| 6789 | SPBC23E6.02_DN | TGCAACCCGGCTGGATCTTT |
| 6790 | SPBC23E6.03c_UP | TAGTGAGGGGCAGGCGGATG |
| 6791 | SPBC23E6.03c_DN | GCGACGGCGGACTGGGTTAG |
| 6792 | SPBC23E6.04c_UP | CACACGGTCCAGACCTGGTT |
| 6793 | SPBC23E6.04c_DN | ATGGGTCACAGTGCGACGTG |
| 6794 | SPBC23E6.05_UP | TCCGAGACGTCCGTTACGCT |
| 6795 | SPBC23E6.05_DN | CAACCAGGTGTCCTCAGGCT |
| 6796 | SPBC23E6.07c_UP | GCGGGAGGGGTGAAACTGAG |
| 6797 | SPBC23E6.07c_DN | TGGGGGGGAAGGCGAGATGG |
| 6798 | SPBC23E6.08_UP | AGAAGCGAACGAGCCCCACA |
| 6799 | SPBC23E6.08_DN | GGAGCGGCAGGGGAGTTTCG |
| 6800 | SPBC23E6.09_UP | ACTTAAAGGGATGCGGGGGG |
| 6801 | SPBC23E6.09_DN | GGCCGCAAATACGGGAGAGA |
| 6802 | SPBC23E6.10c_UP | AGGCATGCGCGAGAAAACAT |
| 6803 | SPBC23E6.10c_DN | ACCTATCATGTGGCGTCGGG |
| 6804 | SPBC23G7.04c_UP | TTTCGGTTGCGTGGGCTTCA |
| 6805 | SPBC23G7.04c_DN | TATTTGTTGCGTCGGGGCGG |
| 6806 | SPBC23G7.06c_UP | GGCTAGGCTTTGTTGGCGGC |
| 6807 | SPBC23G7.06c_DN | TTGCTCCCGTCCCTTATGCC |
| 6808 | SPBC23G7.07c_UP | CGACCCCGGAAGGCCTAGTG |
| 6809 | SPBC23G7.07c_DN | GACTTCCGCGCGCATTACCG |
| 6810 | SPBC23G7.10c_UP | GTCCTTTTGCGGGGGCTTGT |
| 6811 | SPBC23G7.10c_DN | AGCTCCTCCGCTCCCCGGTA |
| 6812 | SPBC23G7.11_UP | TTTACCAGGCTGCCCAGAGC |
| 6813 | SPBC23G7.11_DN | CCTCTGCCGTCTCCCTTGCC |
| 6814 | SPBC23G7.14_UP | TGGGGGTGAGGCGGGAGAGT |
| 6815 | SPBC23G7.14_DN | TCCGCTTTTCTTTCGCCACA |
| 6816 | SPBC244.01c_UP | CACCCATCCGCGAAGTCAAA |
| 6817 | SPBC244.01c_DN | GGATGGGCGGAGCTGAGTTG |
| 6818 | SPBC24C6.02_UP | GCGCCAACACCTAACGCGAG |
| 6819 | SPBC24C6.02_DN | CGGCGCGTCTTTGGCACTAA |
| 6820 | SPBC24C6.03_UP | ATGTTCAGAGCCCCACCCCG |
| 6821 | SPBC24C6.03_DN | GCAAGCCAGATAGCACCGCC |
| 6822 | SPBC24C6.04_UP | AGAAACCGCGCGAAAAGGAA |
| 6823 | SPBC24C6.04_DN | GTGGCTGGCGAGAAAGCTGT |
| 6824 | SPBC24C6.06_UP | TCGATAGGCGCAGCACAGTC |
| 6825 | SPBC24C6.06_DN | TGACACACGGTCTGACCCCT |
| 6826 | SPBC24C6.07_UP | TTGCAAACTGCGTCAGGGGA |
| 6827 | SPBC24C6.07_DN | GATCCCCTCACGACCAAGCC |
| 6828 | SPBC24C6.08c_UP | CAGCGGTCGAGAAGGATAGG |
| 6829 | SPBC24C6.08c_DN | ACCTCCATCCCCGACACCGC |
| 6830 | SPBC24C6.09c_UP | CGGTTGACAGTCCTAGCGGT |
| 6831 | SPBC24C6.09c_DN | TGGCTGTCCAGGGCTAAAGG |
| 6832 | SPBC24C6.10c_UP | ACTGCGGTCACGTGCGGAAA |
| 6833 | SPBC24C6.10c_DN | AGGGAGTGCAGAAAGCCGCT |
| 6834 | SPBC24C6.11_UP | CAAAAACGGACATTCCCCGC |
| 6835 | SPBC24C6.11_DN | CCCAGCACGACCACGACTCG |
| 6836 | SPBC25B2.03_UP | TATTCTCGCAGGCCCACACG |
| 6837 | SPBC25B2.03_DN | CGTCAAACGATCCGGCGCTC |
| 6838 | SPBC25B2.04c_UP | AGGCGACACGGGCATAGCTC |
| 6839 | SPBC25B2.04c_DN | CGGTCCATGGCGGGAAAAGA |
| 6840 | SPBC25B2.06c_UP | GAATGCGCAAACGGGGAGAG |
| 6841 | SPBC25B2.06c_DN | AGCGCGGTCGGGGTGAAACT |
| 6842 | SPBC25B2.07c_UP | GTACTTGGACGCCGGTGGGG |
| 6843 | SPBC25B2.07c_DN | ACATGGTGAAGCGGGGGATC |
| 6844 | SPBC25B2.08_UP | AGTGAAAAAGCCCGCGATGC |
| 6845 | SPBC25B2.08_DN | GAAGCACCGGCCAACTCCAT |
| 6846 | SPBC25B2.09c_UP | TTCATCTCCCGCGCTGTCGG |
| 6847 | SPBC25B2.09c_DN | CGCAAATGATGAAAGGCGGC |
| 6848 | SPBC25B2.10_UP | AAACGGGGGGCGCTAGGTCA |
| 6849 | SPBC25B2.10_DN | CTAGCATGACGGAGGGGGCG |
| 6850 | SPBC25B2.11_UP | CGCACGGGATGAAAACAGCA |
| 6851 | SPBC25B2.11_DN | ATGTTGTTGCCCGGGCTTGA |
| 6852 | SPBC25D12.02c_UP | AAGACGGTAGCGCCCCAGAG |
| 6853 | SPBC25D12.02c_DN | AGGCGAAAGTTAGGGGCGGG |
| 6854 | SPBC25D12.03c_UP | ACGGGGCTCGCATGTACTTC |
| 6855 | SPBC25D12.03c_DN | TATGCGGTGCGAGCAACTCC |
| 6856 | SPBC25D12.05_UP | ATGGCGTAGATCGGCGTCGT |
| 6857 | SPBC25D12.05_DN | AACCGTGTGCGGCTGTACAA |
| 6858 | SPBC25D12.06_UP | TAAACAGGGCCGAGGATGCG |
| 6859 | SPBC25D12.06_DN | GCCACAGAGCCCAGATCCGG |
| 6860 | SPBC25H2.03_UP | CCCACCCCCTTGCTACCGAG |
| 6861 | SPBC25H2.03_DN | AGGGTTGACTTCTGGCCGGA |
| 6862 | SPBC25H2.04c_UP | TGAACCGATACCAACCGCCA |
| 6863 | SPBC25H2.04c_DN | AGAAACGTATGCCACCCGCC |
| 6864 | SPBC25H2.05_UP | AGCGTCGCGGCGATCCTATT |
| 6865 | SPBC25H2.05_DN | CGGTTACCCTAGCGGACGTT |
| 6866 | SPBC25H2.07_UP | AACGTCTCGCCGTCGCATCC |
| 6867 | SPBC25H2.07_DN | CGGACTGCGCCAACACCATT |
| 6868 | SPBC25H2.08c_UP | AGGTAATGCAAGGGTGCCGG |
| 6869 | SPBC25H2.08c_DN | GCGTGTCGGACGGGCCTTTT |
| 6870 | SPBC25H2.09_UP | ACGTCATGTTGGGTTCGGCG |
| 6871 | SPBC25H2.09_DN | ATGATGAGGCGGATGGGGGT |
| 6872 | SPBC25H2.10c_UP | GAGGAGACGCGGAGTGGGTG |
| 6873 | SPBC25H2.10c_DN | TTCACCCCATATGCCCGCTC |
| 6874 | SPBC25H2.11c_UP | GGTTCGTCAGCCCTCGGCAT |
| 6875 | SPBC25H2.11c_DN | TTCGGTTTTCCCCGGGTCGT |
| 6876 | SPBC25H2.12c_UP | GATGAGACGGGCATAGCGCA |
| 6877 | SPBC25H2.12c_DN | AGTTGCTGGTCGCGGGTTTT |
| 6878 | SPBC25H2.13c_UP | CTTGCGTCATAGGTGGGCCC |
| 6879 | SPBC25H2.13c_DN | CTTCCCGGCGCTTGGTTCAT |
| 6880 | SPBC25H2.14_UP | GGCTGCTCGTGGGTGTTGGA |
| 6881 | SPBC25H2.14_DN | CCCCCCGGCAAAGCTGAAAC |
| 6882 | SPBC25H2.15_UP | GAACCGAAAACCCCCAAGCA |
| 6883 | SPBC25H2.15_DN | GGACCTACCATCGCCCGCAC |
| 6884 | SPBC25H2.16c_UP | GCAGTACGAGCCGGCAGCAT |
| 6885 | SPBC25H2.16c_DN | TCGTCCGCCAAAACGTCACA |
| 6886 | SPBC26H8.01_UP | AGCTGCAGGGGTCGGTTGAA |
| 6887 | SPBC26H8.01_DN | ACCCAACCCTAGCCATGCGA |
| 6888 | SPBC26H8.02c_UP | TGAGGACGGGAGCGGAGCAT |
| 6889 | SPBC26H8.02c_DN | TACGTCCAAGCCACATCGGG |
| 6890 | SPBC26H8.03_UP | ATGGCCGTCTAACTGGCGCA |
| 6891 | SPBC26H8.03_DN | AGGACAGTCCGAATCGTGCG |
| 6892 | SPBC26H8.04c_UP | ATGACACCAACCCGGGAACC |
| 6893 | SPBC26H8.04c_DN | GCGCCGGTTGCAATTGTTCC |
| 6894 | SPBC26H8.05c_UP | AGCAAACTGTGGACCCCGGA |
| 6895 | SPBC26H8.05c_DN | CGTGTATGGAGTGCGGCAGG |
| 6896 | SPBC26H8.06_UP | AGGAGCCGCTCATGTGTGTG |
| 6897 | SPBC26H8.06_DN | CGCAGTGACCAGGACCTGAA |
| 6898 | SPBC26H8.07c_UP | CCGCCTCCTTTTCCACCCTC |
| 6899 | SPBC26H8.07c_DN | CCAAGCCAAGCAGCCACTCC |
| 6900 | SPBC26H8.08c_UP | CAGCCGGTCATTCCCCACAG |
| 6901 | SPBC26H8.08c_DN | CGTATTGCCTGAGGGGCGGT |
| 6902 | SPBC26H8.09c_UP | TTCGCGTGCGGTGACCTCTT |
| 6903 | SPBC26H8.09c_DN | CAACTAACCTCGGTCCCGCT |
| 6904 | SPBC26H8.10_UP | ATCCCCTCCACGCAACCGAT |
| 6905 | SPBC26H8.10_DN | CCGCAAACCCCGTCCAACAA |
| 6906 | SPBC26H8.11c_UP | GAACCCCGGAAGACCCCCGT |
| 6907 | SPBC26H8.11c_DN | GTGAGCGAGGCGGTTTGTGG |
| 6908 | SPBC26H8.12_UP | CGGGCACCTGGCTATACCGT |
| 6909 | SPBC26H8.12_DN | CAATCCCGCCGAAGACATGA |
| 6910 | SPBC26H8.13c_UP | CCACGACCCCTCACGAACGC |
| 6911 | SPBC26H8.13c_DN | GCATCGGGCTCTCCTTTCGG |
| 6912 | SPBC26H8.14c_UP | TGTGCAAAACGTGACGCGGC |
| 6913 | SPBC26H8.14c_DN | TCCAGGCCGCGGTTAGGGAG |
| 6914 | SPBC27.01c_UP | AGGCGATGCACCAAGCAAAA |
| 6915 | SPBC27.01c_DN | CGGAGCCGTCAGGAAGCATT |
| 6916 | SPBC27.02c_UP | TAAACCCTCTTGCCCCCGCG |
| 6917 | SPBC27.02c_DN | GAGCACCACCAAAGCACCGG |
| 6918 | SPBC27.03_UP | CTCAACTACCCCAAGCGCCG |
| 6919 | SPBC27.03_DN | TATGCTCTCGCCTTTGCCCG |
| 6920 | SPBC27.04_UP | GTCGCTCTTCACCCTCGCCG |
| 6921 | SPBC27.04_DN | GCCGCGGGGTTCTGAGTTCC |
| 6922 | SPBC27.05_UP | GTCTCCCATCGCGCTCCACT |
| 6923 | SPBC27.05_DN | GCCGGATATGTGGGGGGAAG |
| 6924 | SPBC27.06c_UP | GGGCGCGGAGGGTTAGGACT |
| 6925 | SPBC27.06c_DN | CGTGACTGAAGAGGCGGTGG |
| 6926 | SPBC27B12.03c_UP | TGCTCCGCGCCTGTAACTGT |
| 6927 | SPBC27B12.03c_DN | GGAAACTCGGGGAAAGGCGT |
| 6928 | SPBC27B12.05_UP | GAGCCCGGGACACATCGAAA |
| 6929 | SPBC27B12.05_DN | CATAAGGCCATGGGGGGGGA |
| 6930 | SPBC27B12.06_UP | GTGCCCCTGCTCAAACCCGT |
| 6931 | SPBC27B12.06_DN | GATCGCCCGTTTTCATCCCA |
| 6932 | SPBC27B12.07_UP | CCCGCAACGGACTCACAAGG |
| 6933 | SPBC27B12.07_DN | GTGATCTCGAGTGGCGTCTG |
| 6934 | SPBC27B12.08_UP | CGATGTGCGTCACCTGAACC |
| 6935 | SPBC27B12.08_DN | TCTCGGATCAGAGGCCCAGT |
| 6936 | SPBC27B12.10c_UP | ACACCCCGCTTGCCCAGAAA |

FIG.41

| Sequence number | Name | Base sequence | Sequence number | Name | Base sequence |
|---|---|---|---|---|---|
| 6937 | SPBC27B12.10c_DN | GGACCTCCGCCCTTCTTCGA | 7039 | SPBC2A9.05c_DN | ACCCCCGCGACTAGACTTG |
| 6938 | SPBC27B12.11c_UP | AAACCGGTCGACTTGCTCCA | 7040 | SPBC2A9.06c_UP | CGTCACCGAGACCCTAGCCG |
| 6939 | SPBC27B12.11c_DN | TGCAGGGAGTGGTGACGGGT | 7041 | SPBC2A9.06c_DN | GCGCAATTCCACCTCAGCAG |
| 6940 | SPBC27B12.14_UP | CTGAGRAGGGGAGTGCGGGT | 7042 | SPBC2A9.07c_UP | TAAAACCAATGCCGCGGACC |
| 6941 | SPBC27B12.14_DN | ACAAGCGCCGAACAGCCACA | 7043 | SPBC2A9.07c_DN | GACCCCCGGCACGTATTCCT |
| 6942 | SPBC28E12.03_UP | TTTTACGAACCGGCTCGGGG | 7044 | SPBC2A9.08c_UP | TAGGCGGACTCGGGCAGAAT |
| 6943 | SPBC28E12.03_DN | ACGTCTTACCCGGCGCACAA | 7045 | SPBC2A9.08c_DN | TTCGCGCCTCCACCCTCAGT |
| 6944 | SPBC28E12.04_UP | TGGGCTCGGCACGTATCCGG | 7046 | SPBC2A9.13_UP | GCACGGTGATGCGTCGATGA |
| 6945 | SPBC28E12.04_DN | CCTAGGTGTTTCGGGGTCGC | 7047 | SPBC2A9.13_DN | TCATCCGTCGGAGCAGAGCA |
| 6946 | SPBC28F2.02_UP | CGCCGCCAGAAACCGATTAC | 7048 | SPBC2D10.03c_UP | TCCCTGGCTCTTCTGCCACG |
| 6947 | SPBC28F2.02_DN | CCCTTCCAGACCCAGCCAACC | 7049 | SPBC2D10.03c_DN | GGACCTGCCGCGCTTTACAT |
| 6948 | SPBC28F2.03_UP | GGTCCAAAGGGCCAGATGCG | 7050 | SPBC2D10.04_UP | TGTGCTCTTGCGTCCCGATT |
| 6949 | SPBC28F2.03_DN | TTGCGAGCACTACCGGGCTA | 7051 | SPBC2D10.04_DN | GCGGGCTTCTCTTGCTGGGT |
| 6950 | SPBC28F2.05c_UP | TTACATGGTGCGCGTCGGGT | 7052 | SPBC2D10.05_UP | ACCACCAGACACGCTCCGCT |
| 6951 | SPBC28F2.05c_DN | CTCGGCCTTCGCTCTCCCTC | 7053 | SPBC2D10.05_DN | GGGCGGGTGGCTAAAATCGG |
| 6952 | SPBC28F2.06c_UP | CCGGGGTTTAGGATCGAGGC | 7054 | SPBC2D10.06_UP | GCGGGGGGATAGGTGTAGGC |
| 6953 | SPBC28F2.06c_DN | CCCCATGATGTTTACGCGGC | 7055 | SPBC2D10.06_DN | GTGTCGGTCTTCGGGAGGGC |
| 6954 | SPBC28F2.07_UP | TGGGAGACTTTGGCTGGCGT | 7056 | SPBC2D10.07c_UP | ATTCGGTCGTGGGGGTCCTC |
| 6955 | SPBC28F2.07_DN | TGTCCGCCCCGTCCTTCTGA | 7057 | SPBC2D10.07c_DN | CCGCTGCCCCTTTTATTTCG |
| 6956 | SPBC28F2.08c_UP | CAGCGTCGACCGGGAAAAAC | 7058 | SPBC2D10.08c_UP | GCAACGGAAATACCCCGCAT |
| 6957 | SPBC28F2.08c_DN | GCGGTGGGGTGGCGAATACG | 7059 | SPBC2D10.08c_DN | GAATAGCGGCGTTGGCCAAA |
| 6958 | SPBC28F2.10c_UP | CCTCCAGACAATCGCCCTCC | 7060 | SPBC2D10.09_UP | CTGCGAGGGGGGAACTTTGA |
| 6959 | SPBC28F2.10c_DN | ACCAGACCTTGACCCGCTCG | 7061 | SPBC2D10.09_DN | ATGAGCGACGGTTCGCGAGA |
| 6960 | SPBC28F2.11_UP | CCCGATGCGGCTTGTTCCTG | 7062 | SPBC2D10.10c_UP | GCCCAGCACAGCGTAAACCG |
| 6961 | SPBC28F2.11_DN | ATCCTTTTGGCGCGCGTGTA | 7063 | SPBC2D10.10c_DN | CACCCCGCACCACGATCAGTC |
| 6962 | SPBC28F2.12_UP | TGCTCGTACCTTGCCCCTGG | 7064 | SPBC2D10.11c_UP | AAGTTGGATGGGGGTCGGCC |
| 6963 | SPBC28F2.12_DN | CCGGGGAAATCGCAGTGTCT | 7065 | SPBC2D10.11c_DN | CGTTTCTCTGCGAATGCCG |
| 6964 | SPBC29A10.04_UP | AACCGCCCCAAGAAATCCGA | 7066 | SPBC2D10.12_UP | CGGTTGCCCACTTTCGTCCC |
| 6965 | SPBC29A10.04_DN | GTCAAACTTAAATCGCGGCC | 7067 | SPBC2D10.12_DN | CTCCTCCTGATGCCCAACCG |
| 6966 | SPBC29A10.05_UP | CACCATTTCTCGGCGTCCC | 7068 | SPBC2D10.13_UP | TCGGAAGGGGGCTAGGGGAG |
| 6967 | SPBC29A10.05_DN | TTTGTCGGGGCTGTGCAC | 7069 | SPBC2D10.13_DN | ACCCGCACTTGACCCATTCC |
| 6968 | SPBC29A10.06c_UP | TTCGGGTGTGGTCGGTGTG | 7070 | SPBC2D10.14c_UP | GAAGAAATCCCACCCATCGG |
| 6969 | SPBC29A10.06c_DN | GCTCGCCTCCCGGTTGCCT | 7071 | SPBC2D10.14c_DN | GGAAGGGTTTTTTGGCGCG |
| 6970 | SPBC29A10.07_UP | CCCCAGAACCAGCCGCACACA | 7072 | SPBC2D10.15c_UP | CCCAATGAACCGTAACCACC |
| 6971 | SPBC29A10.07_DN | GGAGGGGACGGTCTTTTGT | 7073 | SPBC2D10.15c_DN | ACTTGTAACCTCCCGCCGGA |
| 6972 | SPBC29A10.09_UP | CCCACTGCCCGAATTGTCAA | 7074 | SPBC2D10.17_UP | TCACCTTAGTGCGACGGGGC |
| 6973 | SPBC29A10.09_DN | GCGCCCCTCCGTATCTAGC | 7075 | SPBC2D10.17_DN | GCCTGTTGGGCTTCGCGTAT |
| 6974 | SPBC29A10.09c_UP | TATTGTAAGCGGCACGGGCG | 7076 | SPBC2D10.18_UP | CGGGAAGGAAGGGTGCCAATA |
| 6975 | SPBC29A10.09c_DN | CAAGTTGCAAGAGGCAGCGC | 7077 | SPBC2D10.18_DN | TCTTCGCCGCGTCTTTCTCG |
| 6976 | SPBC29A10.10c_UP | AAGTGAGGGTACCGAGGGAA | 7078 | SPBC2D10.19c_UP | CCCCACGATCATTTCCGCCT |
| 6977 | SPBC29A10.10c_DN | TTCCCACTCAAACCCCGCCT | 7079 | SPBC2D10.19c_DN | GCCGGCACAACGAATGGAGA |
| 6978 | SPBC29A10.11c_UP | GGCCCGCACCATCGTCATTA | 7080 | SPBC2F12.02c_UP | GCCCTAAATAACGCCTAGCCS |
| 6979 | SPBC29A10.11c_DN | TGGCGTTAACCTAGTCGCCC | 7081 | SPBC2F12.02c_DN | CCGCCTGCAATTCGTCAAAG |
| 6980 | SPBC29A10.13_UP | TGGGAGCAGCAACGGGAGAC | 7082 | SPBC2E12.03c_UP | GATTTGCTAACGAGGGCGGG |
| 6981 | SPBC29A10.13_DN | TGCCTGCCAACACTTGCTCA | 7083 | SPBC2E12.03c_DN | GCGTTGCCCCTCTCCTGCTG |
| 6982 | SPBC29A10.14_UP | GGTAATTCCCCGCGAGCCTT | 7084 | SPBC2E12.04_UP | GCGGGCGGGTACTGTAACGG |
| 6983 | SPBC29A10.14_DN | GCGGCGCATCGAATTAAAT | 7085 | SPBC2E12.04_DN | CAGGGTTCCACCGTCCGCAT |
| 6984 | SPBC29A10.15_UP | CCCCTCGCCAAGCAAAGCAA | 7086 | SPBC2E12.05c_UP | AGGCATCAGGTTCGGGGAGG |
| 6985 | SPBC29A10.15_DN | TGTGGCAACGTGATGGAGCT | 7087 | SPBC2E12.05c_DN | AAGATTACCACAGCCGCGCC |
| 6986 | SPBC29A10.16c_UP | CCAACAAAAGGGAGGTTGGG | 7088 | SPBC2E12.07c_UP | GGCGGGGGTTAAACTCAGCTG |
| 6987 | SPBC29A10.16c_DN | GCCTTCGCTGCCCCGATTAA | 7089 | SPBC2E12.07c_DN | CCCCCAAATCACTCCCGCTG |
| 6988 | SPBC2A3.01_UP | CCACCGCTTTTCACCCCGA | 7090 | SPBC2E12.08c_UP | GTCGGCCTAGCACACACCGA |
| 6989 | SPBC2A3.01_DN | GCCAAGGGCGGCCTAACTCT | 7091 | SPBC2E12.08c_DN | TCGCCTTCCATGGGCTTAGC |
| 6990 | SPBC2A3.02c_UP | TTCCCCAGCCCCGCCCTATT | 7092 | SPBC2E12.09c_UP | AGATCCACTGCCCCCCTACC |
| 6991 | SPBC2A3.02c_DN | CACGGGAAAGCATGCGACCA | 7093 | SPBC2E12.09c_DN | TGGGTCCTTGGGGGCTAGTG |
| 6992 | SPBC2A3.03c_UP | CCGCGATACCAGGAGCATGA | 7094 | SPBC2E12.10_UP | GAAAGGGCGATGTTGCGAAC |
| 6993 | SPBC2A3.03c_DN | CGCTTCCAGGTCGTTGATC | 7095 | SPBC2E12.10_DN | AGCGCCGACAGCCCAGACAA |
| 6994 | SPBC2A3.04_UP | AACGCCCGGCCCGTATTAAA | 7096 | SPBC2E12.11c_UP | GATTTGGCGATGGGTCGGTC |
| 6995 | SPBC2A3.04_DN | ACGCGGGACCGGTTCGAATA | 7097 | SPBC2E12.11c_DN | CGCATTTTGCTCGTTCCACG |
| 6996 | SPBC2A3.05_UP | GTTCTTGGATGGAGCGCCGA | 7098 | SPBC2E12.12c_UP | TGCTAATGCTTTGCTCGCGG |
| 6997 | SPBC2A3.05_DN | GGCTGCGGTGCTGTGGTAGA | 7099 | SPBC2E12.12c_DN | AATTCGCAAACCGCGCGAT |
| 6998 | SPBC2A3.06_UP | CGGGGGGGCTCGACTAGCTGAA | 7100 | SPBC2E12.13_UP | CGTTATTTCGTGTGCGCGG |
| 6999 | SPBC2A3.06_DN | TGCCCCCTCTTACATACCG | 7101 | SPBC2E12.13_DN | CGGCAGACGGTGAAGACAGA |
| 7000 | SPBC2A3.07c_UP | CAGCGGTATCACGGTCGGACT | 7102 | SPBC2F12.14c_UP | GCCAATCACGGGGCACTAGT |
| 7001 | SPBC2A3.07c_DN | AACAGTGGCTCAGCTCTCCC | 7103 | SPBC2F12.14c_DN | CCTAAGGCGCGACTTCGCTA |
| 7002 | SPBC2A3.08_UP | CCCACGGATCCGGGCAAACC | 7104 | SPBC2F12.15c_UP | TCATCCGGGCCCGTAGTTTT |
| 7003 | SPBC2A3.08_DN | GCCCGCTTTTCCTTACGGCCA | 7105 | SPBC2F12.15c_DN | GCCGGGGACAAAAATGACGC |
| 7004 | SPBC2A3.09_UP | CCGAGGCTGCATTGGAGCGT | 7106 | SPBC2G2.02_UP | GGCTTACGCGGGGCATTCGG |
| 7005 | SPBC2A3.09_DN | TGTACGATCTGTGCGGCCGG | 7107 | SPBC2G2.02_DN | CGGTGAAGATTGCGCAGTGG |
| 7006 | SPBC2A3.10c_UP | GGTCCCGCTTGGAGTTCCCC | 7108 | SPBC2G2.03c_UP | TCACTCCCGCCGATTGTCCC |
| 7007 | SPBC2A3.10c_DN | TAGCAAACAGCAGACGGCCG | 7109 | SPBC2G2.03c_DN | TGATCCCCTCCCTCCGCACT |
| 7008 | SPBC2A3.11c_UP | AAAAGGTCTATCCGGGGTCG | 7110 | SPBC2G2.04c_UP | GGGATGCGGGCGAGACAGAA |
| 7009 | SPBC2A3.11c_DN | GCGCGTTGTTACGATTGGGA | 7111 | SPBC2G2.04c_DN | CAGTACCCGCTCCCGGCCAAA |
| 7010 | SPBC2A3.12_UP | CGCCGGGGAAAAAAATGTGAG | 7112 | SPBC2G2.06c_UP | TTTTTTGGGGACGGGTTCGGG |
| 7011 | SPBC2A3.12_DN | TTGGCAACCTACCTCCCGCT | 7113 | SPBC2G2.06c_DN | AGGGAGCCCGTAACCGATGGG |
| 7012 | SPBC2A3.13_UP | TGAACGCAGACGGACCCAGG | 7114 | SPBC2G2.07c_UP | TCAACCGGATGGACTGGGGC |
| 7013 | SPBC2A3.13_DN | GGGGGCCAATAACTCGTCCA | 7115 | SPBC2G2.07c_DN | GCGGCCCATGGAATCTCCA |
| 7014 | SPBC2A3.14c_UP | GGTGTGATGGAGTCGGGAGC | 7116 | SPBC2G2.08_UP | CGCGCGACATAGGAACAGCA |
| 7015 | SPBC2A3.14c_DN | CAGTTCCGCCACCAAGCCGT | 7117 | SPBC2G2.08_DN | GAGCCCTGTTCATTCCCCGC |
| 7016 | SPBC2A3.15c_UP | CTGAGTTCCCACAACCCGCA | 7118 | SPBC2G2.09c_UP | GGCCGGCTACGAGGTTTCC |
| 7017 | SPBC2A3.15c_DN | GTACTGCTCGGCTGGCCCTT | 7119 | SPBC2G2.09c_DN | CACTTTCCGCGTTCCTTGGG |
| 7018 | SPBC2A3.16_UP | CCCGGCTCGCATATGGTTCG | 7120 | SPBC2G2.10c_UP | GGTCAGGCCTCGGGTTCATC |
| 7019 | SPBC2A3.16_DN | CTCGCACCCGACACCAAACC | 7121 | SPBC2G2.10c_DN | AGCGCATCCTCGAACCACT |
| 7020 | SPBC2A3.17_UP | TCGCAGGCGGTGAGTGAC | 7122 | SPBC2G2.11_UP | TTTGCGGTTGTCGAGATCGG |
| 7021 | SPBC2A3.17_DN | TCCCCCACCCTTGAGCAAAA | 7123 | SPBC2G2.11_DN | CTTTCTGAGGCGCGCCCTGT |
| 7022 | SPBC2A3.18_UP | ACTCGTTCGGGCTGGCTGGA | 7124 | SPBC2G2.12_UP | CGCGCTTTCCAGTTACCCCG |
| 7023 | SPBC2A3.18_DN | CTGCTCTGCCCTCGAATGCC | 7125 | SPBC2G2.12_DN | CTGGGCCGCGCTCCTAGCCT |
| 7024 | SPBC2A3.21_UP | ACGCGGAGACCGTGTACTTT | 7126 | SPBC2G2.13c_UP | CCCCGTAGCCGGAGCACCAG |
| 7025 | SPBC2A3.21_DN | TCGTCTCAGAGGTCCCACGC | 7127 | SPBC2G2.13c_DN | ACGCCGCACCACATCACAAA |
| 7026 | SPBC2B5.01_UP | CCCCAGTAAACCCAGCCCA | 7128 | SPBC2G2.14_UP | TGCAGAATGGGCGAGACCGA |
| 7027 | SPBC2B5.01_DN | AGCCCACCCTTCACCCGATT | 7129 | SPBC2G2.14_DN | CCCACGCCACTCACTCAGCA |
| 7028 | SPBC2B5.02_UP | AGTGGAGAGGCACCAAGCGC | 7130 | SPBC2G2.15c_UP | ACCACCGCCCCTTCATTGCT |
| 7029 | SPBC2B5.02c_DN | ATGTGCCGTGTGGCGTTCCC | 7131 | SPBC2G2.15c_DN | TGGAGGCGTGGTGGGAATGT |
| 7030 | SPBC2B5.04c_UP | AGCGACAACGACCCAACCCT | 7132 | SPBC2G2.16_UP | AGCGGACGAGCAGCGAGAC |
| 7031 | SPBC2B5.04c_DN | GATGGGGCGTATTGCAGAGCG | 7133 | SPBC2G2.16_DN | GCGTGTAGAGGCGTTGTGGGG |
| 7032 | SPBC2A9.02_UP | AGCCGCCCAATTTCTCCCGA | 7134 | SPBC2G2.17_UP | GGGTCTCGGTTGTGCTGCTG |
| 7033 | SPBC2A9.02_DN | GGCGTCCCTGCGTTCGTTAT | 7135 | SPBC2G2.17c_DN | GGCAATAGGGACGGATGGCA |
| 7034 | SPBC2A9.05_UP | TGGTATCGCGGGCAAGCTTG | 7136 | SPBC2G5.01_UP | CGGGGAACCAAATACGGCGG |
| 7035 | SPBC2A9.05_DN | TTTGCCCCGGTGTGTTCGTTG | 7137 | SPBC2G5.01_DN | GCCAGTCACGAATCGACTGC |
| 7036 | SPBC2A9.04c_UP | CACCGTTACCAGCGGCCCAGG | 7138 | SPBC2G5.02c_UP | ACTTATTTTGCCGGGGGATG |
| 7037 | SPBC2A9.04c_DN | CAGGTCGGGCACATATGCGC | 7139 | SPBC2G5.02c_DN | GAAAAAGCCCGCCCACCAC |
| 7038 | SPBC2A9.05c_UP | CCCCTGAATTGAGCTCCGCC | 7140 | SPBC2G5.03_UP | CGTAAGATTGTGTCCGCGCG |

FIG.42

| Sequence number | Name | Base sequence | Sequence number | Name | Base sequence |
|---|---|---|---|---|---|
| 7141 | SPBC2G5.03_DN | GAGACGGAGATGTGGCGCGA | 7243 | SPBC32H8.02c_DN | TAAGCGCCAGGGGGGAGAG |
| 7142 | SPBC2G5.04c_UP | GCCCCGACCATCCAGAGACA | 7244 | SPBC32H8.03_UP | CATTGGGGAGCGGGTTCAGG |
| 7143 | SPBC2G5.04c_DN | CGGATGGTGCGAATTGATGG | 7245 | SPBC32H8.03_DN | AGCAGCCCATCGAGCCCAGT |
| 7144 | SPBC2G5.05_UP | CTATTTCATGGGAGCGCCG | 7246 | SPBC32H8.04c_UP | GCTTCTCGACCCTCCCTGCA |
| 7145 | SPBC2G5.05_DN | GTTTCGTGCCCGGTGTATCA | 7247 | SPBC32H8.04c_DN | GTGTCCGCCCCTCCAAAGTG |
| 7146 | SPBC2G5.06c_UP | CCCCCGGCAACCAACCTATG | 7248 | SPBC32H8.05_UP | GACCCTACACGTCAAGCGGA |
| 7147 | SPBC2G5.06c_DN | GCACGGAATCATGGAGGCAA | 7249 | SPBC32H8.05_DN | GTCGTGTATGAGCGTCGGGA |
| 7148 | SPBC2G5.07c_UP | ATGAAAGGCAGCGCCAACGT | 7250 | SPBC32H8.06_UP | CGCGCGCACAAACTTCGTAA |
| 7149 | SPBC2G5.07c_DN | ACCTTCCAATGACCCGGCCG | 7251 | SPBC32H8.06_DN | GAGGGGGTGCTGCCTACGGC |
| 7150 | SPBC30B4.02c_UP | GCCGTTTGGGTCTGGTGCTG | 7252 | SPBC32H8.07_UP | TTTTGGCGGCTGTGTTCCGT |
| 7151 | SPBC30B4.02c_DN | GACCGCGCAGCCCCTATAAC | 7253 | SPBC32H8.07_DN | ATGTGAACTGCCCCCCACCG |
| 7152 | SPBC30B4.03c_UP | GAAAGCCCAGCGACCAACCA | 7254 | SPBC32H8.08c_UP | AGCAAAAACAGCCGCGGCAA |
| 7153 | SPBC30B4.03c_DN | TCGCCACCATCGTAACGGC | 7255 | SPBC32H8.08c_DN | AACGTTGCACACGGCTCCAC |
| 7154 | SPBC30B4.04c_UP | TGGGGTGCTACGGCAGGAAC | 7256 | SPBC32H8.09_UP | GCGCCGGAGAGAAGTGGGAA |
| 7155 | SPBC30B4.04c_DN | TAGCTACGTCGGGGGGGGTC | 7257 | SPBC32H8.09_DN | CCGCATTCTCCTCCGCACCT |
| 7156 | SPBC30B4.05_UP | ATCGGTAGACGGGGCTCAGA | 7258 | SPBC32H8.10_UP | CCATTCCAGACGCTTCCCC |
| 7157 | SPBC30B4.05_DN | CCGACGCCGGGTAGGATCAG | 7259 | SPBC32H8.10_DN | CCGCCGCATACAAACGCCAT |
| 7158 | SPBC30B4.06c_UP | TACATTCGGTACCGCGGCCT | 7260 | SPBC32H8.12c_UP | AAAGGGGCGCGGTGTAACGG |
| 7159 | SPBC30B4.06c_DN | TGGCCGAAAAGGGGGTTGGA | 7261 | SPBC32H8.12c_DN | CGTCCCCTTCCCTCAAATCCC |
| 7160 | SPBC30B4.07c_UP | CGGCGGGCACCAGAGATTTT | 7262 | SPBC32H8.13c_UP | GCAAAGCTGTGGGCGGAAGA |
| 7161 | SPBC30B4.07c_DN | CCCATTCGGGCCCACTCTAG | 7263 | SPBC32H8.13c_DN | TTGAATTCGGTCACGGGGGA |
| 7162 | SPBC30B4.08_UP | GTGTGGGCCTGCCTTTGATG | 7264 | SPBC336.01_UP | GGCCGTGGGAAGGATGTCTC |
| 7163 | SPBC30B4.08_DN | ATCTCGCCCCGCTTTTGCAC | 7265 | SPBC336.01_DN | TCACGCGTTTTGTTGGCCCC |
| 7164 | SPBC30D10.02_UP | CCCGACTCTCGCAACGCTCAA | 7266 | SPBC336.03_UP | CCAGGGCGGCTGTCTTGAAT |
| 7165 | SPBC30D10.02_DN | AAGGCGCCCACCTGCTGAAT | 7267 | SPBC336.03_DN | GCCCGGTACACGTAACCGTA |
| 7166 | SPBC30D10.03c_UP | GGCAATACCCACCCCTCACG | 7268 | SPBC336.04_UP | GTGCAGCTCGCCATTCAGGT |
| 7167 | SPBC30D10.03c_DN | TTCCACACAACCGTCCCAGC | 7269 | SPBC336.04_DN | AACAGGAGGCCCAAAGCACC |
| 7168 | SPBC30D10.04_UP | AAGGGGAGGCAGGAAACGGT | 7270 | SPBC336.05c_UP | ACCCTAGCCCGTCTCCGTCG |
| 7169 | SPBC30D10.04_DN | CGCGCCTGTGGTGATGAAAT | 7271 | SPBC336.05c_DN | TACCATTCGTGCCTGCCCCC |
| 7170 | SPBC30D10.05c_UP | TGCTGTGGCGGCTGATAAGC | 7272 | SPBC336.06c_UP | GTGCTTCGAGACGTGGGCGG |
| 7171 | SPBC30D10.05c_DN | GTGCTCCCGTTAAGATGCGA | 7273 | SPBC336.06c_DN | CAAACTGCATATCGCGGGGG |
| 7172 | SPBC30D10.07c_UP | GCTGTGCTGGATCCGGGGTA | 7274 | SPBC336.07_UP | GTGGATGTGTGGGACGGCC |
| 7173 | SPBC30D10.07c_DN | CCCAGCATACTCCCGGTCCC | 7275 | SPBC336.07_DN | TGAAGTGGTGGTCGTGCCCG |
| 7174 | SPBC30D10.08_UP | TCCGAACCACACGTAGCCGA | 7276 | SPBC336.10c_UP | CCCACGGGTCGATCCTACCA |
| 7175 | SPBC30D10.08_DN | AAGCACGGGATGGCGAGACA | 7277 | SPBC336.10c_DN | GACTAACACCCGCCCGCACT |
| 7176 | SPBC30D10.10c_UP | AACGGCCTGAGGCGTAGTTC | 7278 | SPBC336.12c_UP | GGGGGGGAAGCTGGGGCAATA |
| 7177 | SPBC30D10.10c_DN | AAGATGGTCGGAGCACGGCT | 7279 | SPBC336.12c_DN | CAGAGGGGTTAGCGGTGGCC |
| 7178 | SPBC30D10.12c_UP | CTCCCCGTACAAGTCCGCCCC | 7280 | SPBC336.13c_UP | GAATCTCCCGCCGCGCTCCACGT |
| 7179 | SPBC30D10.12c_DN | GGAGGACGCCAGGGAGAGGG | 7281 | SPBC336.13c_DN | TGCGTGGAGGGCTTGGCGATA |
| 7180 | SPBC30D10.13c_UP | TGGAAGCAGGGACCGGGAAT | 7282 | SPBC336.14c_UP | GGAACGGCAGGAACATCCG |
| 7181 | SPBC30D10.15c_DN | CCGCGGCCTCCTTCGTTCTAT | 7283 | SPBC336.14c_DN | CAGATGGATATGCGCGTGCG |
| 7182 | SPBC30D10.14_UP | TTTCCGCGGCTTTTGTGCG | 7284 | SPBC337.03_UP | CCGATGAAGAAACCGGCAA |
| 7183 | SPBC30D10.14_DN | GCGTCTCGGTGTGCTGCCTA | 7285 | SPBC337.03_DN | TAGCGGAGGGATGACCGGGA |
| 7184 | SPBC30D10.16_UP | TTGGGGCTCTTGCAGTGGGT | 7286 | SPBC337.04_UP | GATGCAACAGCAAGGGCGAC |
| 7185 | SPBC30D10.16_DN | CCGTTCCGTTGCCAGGGGTA | 7287 | SPBC337.04_DN | TTGCCGTGTGGGGTGAGTCA |
| 7186 | SPBC30D10.18a_UP | GGTGGTGAGGGAGCTCGTCG | 7288 | SPBC337.05c_UP | ACCGCCAGGCCACAGTATCC |
| 7187 | SPBC30D10.18a_DN | AGGAACCCGCGCAAGCAGAT | 7289 | SPBC337.05c_DN | GATCTGGCTGTGAGGGGCA |
| 7188 | SPBC317.01_UP | CAATATGCCTGGAACCGCCG | 7290 | SPBC337.06c_UP | CGGGCCTCCAGTACAGGGTT |
| 7189 | SPBC317.01_DN | CCACATGCCCGTCCCAACGA | 7291 | SPBC337.06c_DN | CAATGTTAGAGCACGCCCGC |
| 7190 | SPBC31E1.02c_UP | TCGGACCCACAAAAGACGGG | 7292 | SPBC337.07c_UP | CGCGAATTTACGCACCCGAC |
| 7191 | SPBC31E1.02c_DN | TCATGCCTGTGGCTTTCGCA | 7293 | SPBC337.07c_DN | AGGCCGGCTGTGTGCTTTCCC |
| 7192 | SPBC31E1.05_UP | GGTCGGGCACGAAGGATTCC | 7294 | SPBC337.08c_UP | CACCAACCACCCGAGCCCAA |
| 7193 | SPBC31E1.05_DN | ACCGAACTCTCGACGGTCCT | 7295 | SPBC337.08c_DN | CGCCTCTCTTCCGTTGGCAT |
| 7194 | SPBC31F10.02_UP | CTCTTGCGATCGGGGCTCCT | 7296 | SPBC337.11_UP | TGAGCGCCCGAATAGAGCAA |
| 7195 | SPBC31F10.02_DN | AGGTCAGGCGGGAGGGTCA | 7297 | SPBC337.11_DN | CTTGGCGCTGTACCCCTTTC |
| 7196 | SPBC31F10.03_UP | ACGTCCACGACCCCAGTCCC | 7298 | SPBC337.12_UP | TGCCCGGATCCCTAGCTCCC |
| 7197 | SPBC31F10.03_DN | AGCTAGCGCAACCGATCCCG | 7299 | SPBC337.12_DN | GAAAAGGTGGGCGCCAAAGA |
| 7198 | SPBC31F10.04c_UP | TCAAGGACGTTCAGCGCGGT | 7300 | SPBC337.14_UP | CAGTATCTCTCCGGGCCGCC |
| 7199 | SPBC31F10.04c_DN | GCTTTTAACGGGTTGGGCGG | 7301 | SPBC337.14_DN | AGGGCGCATCACTCGGGGTT |
| 7200 | SPBC31F10.06c_UP | TACTGCACGACCCGCCGACAA | 7302 | SPBC337.15c_UP | AATCAGCCCCGACACCGATC |
| 7201 | SPBC31F10.06c_DN | TCCGGAAATCAAGCACGCAA | 7303 | SPBC337.15c_DN | TAACCGGCCATCAACGGGAT |
| 7202 | SPBC31F10.07_UP | CCGAACCTCCGGATCAATGC | 7304 | SPBC342.02_UP | CTGCGTACCTGCATCCGTCG |
| 7203 | SPBC31F10.07_DN | GATGGTCCGGTTCGGAGCG | 7305 | SPBC342.02_DN | CCTGACGCGCCCCTTACGAC |
| 7204 | SPBC31F10.08_UP | GGGGAACACAGGACCAGGGA | 7306 | SPBC342.03_UP | CCCGAATACGCCACCCAATG |
| 7205 | SPBC31F10.08_DN | ACAAGGGCCCGAAATGAGC | 7307 | SPBC342.03_DN | GTTTCGCGTTCGGGGTCTGT |
| 7206 | SPBC31F10.09c_UP | ACCGTTAGCCCGTTTTTCGA | 7308 | SPBC342.04_UP | CCACTCCCATCATCCCGCTGC |
| 7207 | SPBC31F10.09c_DN | TTTGACGAGCCTCGCGACG | 7309 | SPBC342.04_DN | GCACCACCGGCCTACAATGA |
| 7208 | SPBC31F10.10c_UP | TGCGTGGTGAAATGGGGCAT | 7310 | SPBC342.05_UP | GGGGCAACAACGACCTGGAG |
| 7209 | SPBC31F10.10c_DN | GGCTGGCTTGGGTTAGGTGC | 7311 | SPBC342.05_DN | GAAGCAGGGAGCGGGGTGAG |
| 7210 | SPBC31F10.12_UP | ACGCAGTTGGTTGCGAGGCGA | 7312 | SPBC342.06c_UP | GCTTGGCAGGCCGGATTACA |
| 7211 | SPBC31F10.12_DN | TCGCTCCCCTCGCACAGATA | 7313 | SPBC342.06c_DN | GGGGGCTTGAACCGGGATGA |
| 7212 | SPBC31F10.13c_UP | AGCAAGCTGGTCACGTCACG | 7314 | SPBC354.02c_UP | GGCAAAAAGTGGGCAGGGT |
| 7213 | SPBC31F10.13c_DN | CCCATGCGGGCTACAAGTCG | 7315 | SPBC354.02c_DN | ACCCAGGAACTACCAAGCGA |
| 7214 | SPBC31F10.14c_UP | AAGGGGAGCAGACGGAGGAG | 7316 | SPBC354.03_UP | TACCAAACGCACGGAAACCC |
| 7215 | SPBC31F10.14c_DN | CGCCACTAGCGCTCATTCCC | 7317 | SPBC354.03_DN | TCCTGTTTATGCCGAGCCGG |
| 7216 | SPBC31F10.15c_UP | CCCTTGCCGGGGTGTTGGAAT | 7318 | SPBC354.04_UP | CAAAATGCTAACAGGCGCGGC |
| 7217 | SPBC31F10.15c_DN | TACGGGCTCTTTTTTGGCGG | 7319 | SPBC354.04_DN | ACCAAGCACAGCGCAACTCG |
| 7218 | SPBC31F10.16_UP | ATAGGTTTTGCATCGCCGCG | 7320 | SPBC354.05c_UP | CACCGACGAGCAGGCGATAA |
| 7219 | SPBC31F10.16_DN | AACTTTGGTCCGCGCTCGAG | 7321 | SPBC354.05c_DN | TAGGTGTTGGGGCTTTGCGG |
| 7220 | SPBC31F10.17c_UP | TCCGCGTCGCAAAACTCTTC | 7322 | SPBC354.06_UP | CGTTTGATTCGGGATGGCCA |
| 7221 | SPBC31F10.17c_DN | CCAGCAAGACACGCGGCTCCG | 7323 | SPBC354.06_DN | CGGTTGGGCTGCTCGTGATC |
| 7222 | SPBC32C12.02_UP | ACCTCGCAATCCCCAGCAAG | 7324 | SPBC354.07c_UP | GTTCCCTTCCCGGCTTGTGG |
| 7223 | SPBC32C12.02_DN | CATTTACCCGCTGCCCCACT | 7325 | SPBC354.07c_DN | CACAGCACCGAGCACCATGA |
| 7224 | SPBC32C12.03c_UP | TGAGGGTTCGAGCGGGGAGT | 7326 | SPBC354.08c_UP | AACTTGTGGACGGGGGGGCT |
| 7225 | SPBC32C12.03c_DN | GCCTTCCCCCAAGTCAA | 7327 | SPBC354.08c_DN | TGTGCCAGTGTCCTGGATCG |
| 7226 | SPBC32F12.02_UP | CAAGCCAAGGCGAGCCCCTG | 7328 | SPBC354.09c_UP | GTAGGGGGGTGCGGTTAGGG |
| 7227 | SPBC32F12.02_DN | TTTCATTCGCAGCGTCCAAG | 7329 | SPBC354.09c_DN | CCCCAATCGCTCTGCCACAA |
| 7228 | SPBC32F12.03c_UP | GACATTAAGAGGACCGCGGG | 7330 | SPBC354.10_UP | GGGCGGGCGAAAGGTTACTC |
| 7229 | SPBC32F12.03c_DN | CAGCAGGCGGGGAATATCG | 7331 | SPBC354.10_DN | TTTGAGCGCTCGACCCGA |
| 7230 | SPBC32F12.04_UP | TCTTCGTGGCGGTTCTGTGC | 7332 | SPBC354.11c_UP | ACGGGGGGTGTTGTTGGTGG |
| 7231 | SPBC32F12.04_DN | AGGACGCCAGGCAGGAAT | 7333 | SPBC354.11c_DN | AACTTGGTTGTGCCACGTTA |
| 7232 | SPBC32F12.06_UP | CAAGCCCTGGCTAAGACCCA | 7334 | SPBC354.12_UP | AGTCCCCGGCAGTCGATAAG |
| 7233 | SPBC32F12.06_DN | TGATCGTGCGACGTCAAGGA | 7335 | SPBC354.12_DN | TAATCGGTGCTGGGAACGGC |
| 7234 | SPBC32F12.07_UP | GCGGTGCTTCTGATGCTTGC | 7336 | SPBC354.13_UP | CGGGTACGCTAAGAAGGTGCT |
| 7235 | SPBC32F12.07c_DN | ATGCGCCGATGTTCGTTGGT | 7337 | SPBC354.13_DN | GAGGGGGCTTTCGGCCAACT |
| 7236 | SPBC32F12.08c_UP | GCCGGGTTCCGTCACGTCTTA | 7338 | SPBC354.14c_UP | ACTCCGCTCCCTTCCCCCAC |
| 7237 | SPBC32F12.08c_DN | TTCCGTACGGCTACCCCAGT | 7339 | SPBC354.14c_DN | TGTACATCACGGCCCGAGTG |
| 7238 | SPBC32F12.09_UP | CTGCCGCAGGCTGCTAAT | 7340 | SPBC354.15_UP | AACACGCGTTGCCGATCTCA |
| 7239 | SPBC32F12.09_DN | GCAGCGAGGTTAACGGGGAG | 7341 | SPBC354.15_DN | TCCGAGCGGGTCATGAAAGG |
| 7240 | SPBC32F12.12c_UP | GGGGGAAGTCAGGTGTGCGC | 7342 | SPBC359.02_UP | AGACCCCGACGCTACCGCTT |
| 7241 | SPBC32F12.12c_DN | GATACCCTCCGCATTGGCC | 7343 | SPBC359.02_DN | AATCTTGGGTGCGTCGGGAG |
| 7242 | SPBC32H8.02c_UP | TGGTCGTGGTTCGCTGGATG | 7344 | SPBC359.03c_UP | CCATCACGCAACCACTCGCC |

FIG.43

| Sequence number | Name | Base sequence | Sequence number | Name | Base sequence |
|---|---|---|---|---|---|
| 7345 | SPBC3B9.03q_DN | CCTCCACCCCGTCAGCCTCA | 7447 | SPBC3B9.19_DN | CGTTTCCCGGTGCGTATCTG |
| 7346 | SPBC359.04c_UP | GAGGGGCCGGGTGGAGTAGA | 7448 | SPBC3D6.02_UP | ATGCTTAGGCTTGGTTGCGG |
| 7347 | SPBC359.04c_DN | CTGCTGCTCCGGTCCGCCAT | 7449 | SPBC3D6.02_DN | CCCACCCGGCGACAGAAATT |
| 7348 | SPBC359.05_UP | GGGGACACAGGCAAAACGGG | 7450 | SPBC3D6.03c_UP | CGGTTACTCGCGCTGTACAA |
| 7349 | SPBC359.05_DN | CCGCACAGGACAAACACGCA | 7451 | SPBC3D6.03c_DN | CCCGGTACGGCTGGATACAA |
| 7350 | SPBC359.06_UP | ACTGAAGGACCAAGCGCGGA | 7452 | SPBC3D6.04c_UP | GGTGCCAAAGACAGGCGGAA |
| 7351 | SPBC359.06_DN | GAGACCCATTTCCGGATGAT | 7453 | SPBC3D6.04c_DN | GCTTTGGTGCCTTGGGCTGC |
| 7352 | SPBC36.01c_UP | TGGCGGGCTGAGGGACTTTG | 7454 | SPBC3D6.05_UP | ACGCAGACTCGCGTTGACGA |
| 7353 | SPBC36.01c_DN | TTTTGTCCGTTTTCCCGCCG | 7455 | SPBC3D6.05_DN | TCTGGCTCACGGCTGTACAA |
| 7354 | SPBC36.02c_UP | CCAATCCACTCCTGCTGCGA | 7456 | SPBC3D6.06c_UP | CCTAACCGCCGCTGAACGAA |
| 7355 | SPBC36.02c_DN | CACACCCGCACAACCCCAAT | 7457 | SPBC3D6.06c_DN | TGATGACGCCGGTGGAAGA |
| 7356 | SPBC36.03c_UP | CGAAAACCTCACGCCCGCAG | 7458 | SPBC3D6.07_UP | TGCCCAACATTACCCACGGA |
| 7357 | SPBC36.03c_DN | TCACCGATACCCAGCCAACG | 7459 | SPBC3D6.07_DN | TCGTACTGGTCTGGGGTTTG |
| 7358 | SPBC36.04_UP | CCCGAACAGGGCATGGTAGA | 7460 | SPBC3D6.08c_UP | CGAGGTACGCGTAGCCAACA |
| 7359 | SPBC36.04_DN | TCTCGCGCGGTCCATCCATA | 7461 | SPBC3D6.08c_DN | ACCGCACGGGACTCTCACGTA |
| 7360 | SPBC36.05c_UP | TTAGTGATTTCGCGCUCGGT | 7462 | SPBC3D6.09_UP | CTCAGCTGCGTGTAGCCCAT |
| 7361 | SPBC36.05c_DN | CTGGGTTCTGGAAATTAGCGGC | 7463 | SPBC3D6.09_DN | GTGGGGCTCCGCGTGATTAA |
| 7362 | SPBC36.07_UP | GGAGCCCCGAAAGGCGATA | 7464 | SPBC3D6.10_UP | TCCCAAAAACGGCCGCACATA |
| 7363 | SPBC36.07_DN | GCCCGATCACGTACAGCCGC | 7465 | SPBC3D6.10_DN | GTGGGGTTTGGACGGACGGT |
| 7364 | SPBC36.10_UP | AAATGAACGTGCAGGTCACC | 7466 | SPBC3D6.11c_UP | GATCGGGAGACGCCCTTTT |
| 7365 | SPBC36.10_DN | CTGCCCACCCTCCGAAACAG | 7467 | SPBC3D6.11c_DN | CAAAAGCTGCCCCAACACGG |
| 7366 | SPBC36.11_UP | CCTCCTTCCCACCCTCGCAG | 7468 | SPBC3D6.12_UP | AAGCATTCCCAACGCGAGGC |
| 7367 | SPBC36.11_DN | CCGTTATCCTCAGCCCGTGC | 7469 | SPBC3D6.12_DN | TGGGCCTCACTCTGCGGGAT |
| 7368 | SPBC365.01_UP | GGGCCCATCGTCGGTCAGTC | 7470 | SPBC3D6.13c_UP | GCCCGACGGAAACCGATCAC |
| 7369 | SPBC365.01_DN | CGCCAGCGGGGGGAGTAAGT | 7471 | SPBC3D6.13c_DN | CCAAGTAGCCCACACCGCAA |
| 7370 | SPBC365.02c_UP | TAGCGGCGGTGCAGATCAAG | 7472 | SPBC3E7.02c_UP | GCCGTTGGAGTGCAGTTCCG |
| 7371 | SPBC365.02c_DN | AGCAGGAGGTTGTGGGCCGA | 7473 | SPBC3E7.02c_DN | TTGCAGTTGGCTTTGCCCTG |
| 7372 | SPBC365.04c_UP | GGGCCGACGTATGCGGGTAA | 7474 | SPBC3E7.05c_UP | GGCTCTGCGGGACCAATCAG |
| 7373 | SPBC365.04c_DN | TGACTAGCGTCCAGGTCACC | 7475 | SPBC3E7.05c_DN | GCGCCTAAATTGCCGATTGG |
| 7374 | SPBC365.07c_UP | GGGTAGGCAGGGGAGTGGGC | 7476 | SPBC3E7.06c_UP | ATCTACACGACTGCGTCGCI |
| 7375 | SPBC365.07c_DN | ATCTTTTGGCTCGGCGGTCG | 7477 | SPBC3E7.06c_DN | CCCCCCGAACTGACCCCTTT |
| 7376 | SPBC365.08c_UP | AGGGCGCGGGCGACTTGTAT | 7478 | SPBC3E7.07c_UP | CCTCGAAGAACACCGCTGGC |
| 7377 | SPBC365.08c_DN | TTGGGGGTATCGTGGCATGC | 7479 | SPBC3E7.07c_DN | TTCCGCTTCACGCATTCCGC |
| 7378 | SPBC365.09c_UP | ACTAACCATCGCACCGGCCA | 7480 | SPBC3E7.08c_UP | TCCTAGCCCCGCACGAACGT |
| 7379 | SPBC365.09c_DN | GTGGCCAACCTCCCCGCTCT | 7481 | SPBC3E7.08c_DN | TTTGGCCCGAACCATCGCTA |
| 7380 | SPBC365.10_UP | CTTGCCAGCCCTTTGCCGTG | 7482 | SPBC3E7.09_UP | TGTTGGGCTTCCTTCGCTGG |
| 7381 | SPBC365.10_DN | GCCCGGGAGAGGACTCGACA | 7483 | SPBC3E7.09_DN | AAAAGCCCGCCAAGAGACCA |
| 7382 | SPBC365.11_UP | GTTGCGCGATGGTTGAGGTG | 7484 | SPBC3E7.10_UP | GCTGGAAGACGTGCGAGGATA |
| 7383 | SPBC365.11_DN | AGTTTCGGCGGGGGTCAGAG | 7485 | SPBC3E7.10_DN | CAGGGGTGTTGGGGAAAGGC |
| 7384 | SPBC365.12c_UP | TGCATATCGCACGACGGGGA | 7486 | SPBC3E7.11c_UP | GCGGGCCATTGCTTTTGTCA |
| 7385 | SPBC365.12c_DN | AGGGTTTGGGCGTTTGCGGT | 7487 | SPBC3E7.11c_DN | ACACGTTTTCCCCACCCCCC |
| 7386 | SPBC365.14c_UP | AATTTTGGAACGCGCCCTCA | 7488 | SPBC3E7.12c_UP | CCGGCCTATAGCACCCAAA |
| 7387 | SPBC365.14c_DN | AGGGGTGTGCAAAGGTCCGG | 7489 | SPBC3E7.12c_DN | GGCACGGCATTGGGGGACTA |
| 7388 | SPBC365.16_UP | TTGGCGGGGAGAGAACCTTG | 7490 | SPBC3F6.01c_UP | GGGTTGCTGGGGCCTTCTCT |
| 7389 | SPBC365.16_DN | TAGCCGAGACGCCCACGACC | 7491 | SPBC3F6.01c_DN | TAATCGGAAGGCAGGCTGG |
| 7390 | SPBC365.20c_UP | TATCTTCGTGCCCCGTCCTG | 7492 | SPBC3F6.04c_UP | AAGGATGCAAGTGTGGCGGG |
| 7391 | SPBC365.20c_DN | GGGACGATCGGCAAGCAGGA | 7493 | SPBC3F6.04c_DN | CGCCCCAAGTACAGCTCCCC |
| 7392 | SPBC36B7.02_UP | GCGCCGGCCACAGTATGATC | 7494 | SPBC3H7.01_UP | CTCCCCTCGTTCCCAACCAC |
| 7393 | SPBC36B7.02_DN | GGGGCCTTCGTTCGCGGACTT | 7495 | SPBC3H7.01_DN | CCAGGGATGAACGGGAGCCA |
| 7394 | SPBC36B7.03_UP | TGCGAAACCGTGATTCGGCT | 7496 | SPBC3H7.02_UP | CCCCTACATCCCGCCAACCG |
| 7395 | SPBC36B7.03_DN | AGCAAATGCGGACTGCCTGT | 7497 | SPBC3H7.02_DN | CCCGCCGAAATCAGTGCCAA |
| 7396 | SPBC36B7.04_UP | AATTAGCCCCCGTGCACTCG | 7498 | SPBC3H7.03c_UP | GCGTTTGACGGACCACCAGT |
| 7397 | SPBC36B7.04_DN | GGTTAGGGCGCGCTTTCGAG | 7499 | SPBC3H7.03c_DN | GCTGCGAAGCCGRAAGTAGG |
| 7398 | SPBC36B7.05c_UP | ACAACCATCCTGCACGCCCA | 7500 | SPBC3H7.04_UP | GGGGCGGCGGAATCTTTGAG |
| 7399 | SPBC36B7.05c_DN | CCGTGGTCGTATGTGCGCTT | 7501 | SPBC3H7.04_DN | TACCAAGCCCCGCATTCTGCC |
| 7400 | SPBC36B7.06c_UP | CGCGGTTACAGATTGGCACAG | 7502 | SPBC3H7.05c_UP | ACAAGGACATCGCGGCCACA |
| 7401 | SPBC36B7.06c_DN | TGTCGGGGGCTGTGATGCA | 7503 | SPBC3H7.05c_DN | GCCCGGCGGACTCTCTACT |
| 7402 | SPBC36B7.08c_UP | GAGACGGCAGGCTATGGGG | 7504 | SPBC3H7.06c_UP | TGGTTATTCGCGCGCAGCCT |
| 7403 | SPBC36B7.08c_DN | GAACTTGCTTGTCGCGCGGC | 7505 | SPBC3H7.06c_DN | AATAGCCGCCAGCCGTCCAG |
| 7404 | SPBC3B8.02_UP | TAACGTCGGCTCGAGGCACC | 7506 | SPBC3H7.07c_UP | CTTCAGGGGCGGCTTGGACT |
| 7405 | SPBC3B8.02_DN | CGCCTGTCGGTTGGGGACTA | 7507 | SPBC3H7.07c_DN | TTTCAGCACAGGATCCCGCA |
| 7406 | SPBC3B8.03_UP | TACTGGTGTGCCTTTGCCGG | 7508 | SPBC3H7.09c_UP | CAACAAAGCACTCGCCGGGG |
| 7407 | SPBC3B8.03_DN | GACGGGCTTTAGGGCACAGG | 7509 | SPBC3H7.08c_DN | CTGACGGGAGGATTGGCAT |
| 7408 | SPBC3B8.04c_UP | CACCTAACCGACCCACGCCG | 7510 | SPBC3H7.09_UP | GGGATGACTGGTTGAGGCCG |
| 7409 | SPBC3B8.04c_DN | GAGGGCGCGTGACGCAGGTTCG | 7511 | SPBC3H7.09_DN | GCGGAAGCACGGAGAGCACC |
| 7410 | SPBC3B8.05_UP | TAAAAGGGGGGCCGAAAGCG | 7512 | SPBC3H7.10_UP | TGTACAAGACGCGACGGGGA |
| 7411 | SPBC3B8.05_DN | GACTCCTGCCGCCACCTCC | 7513 | SPBC3H7.10_DN | GGCTTGGCTCGGTTCCGATTC |
| 7412 | SPBC3B8.06_UP | TGCGGGATCTGTCATCCTGG | 7514 | SPBC3H7.12_UP | GGCCCAGCGGCAGTAGTTCGA |
| 7413 | SPBC3B8.06_DN | AAGCCATGTCCGCTCGGAAG | 7515 | SPBC3H7.12_DN | CGCTTCGTCATTGGCCATCC |
| 7414 | SPBC3B8.08_UP | GACAACCCCACTCGCAGGCC | 7516 | SPBC3H7.13_UP | TGGAAACGGGACGATAGCGG |
| 7415 | SPBC3B8.08_DN | AACAAGGAAACCCCGCCAT | 7517 | SPBC3H7.13_DN | ATACGTCCCCCTCCCCCGAG |
| 7416 | SPBC3B8.10c_UP | GCCCGGCTTATTTCGCCATG | 7518 | SPBC3H7.14_UP | ACTAAATCGGTGGGCGCTCG |
| 7417 | SPBC3B8.10c_DN | GTTGGGGGACGGAGCGCTTT | 7519 | SPBC3H7.14_DN | GACCTGCCCTCTTCACCCGA |
| 7418 | SPBC3B8.11_UP | CCCATGCTCTGCCCACTCCT | 7520 | SPBC3H7.15_UP | CGCAGCACTACCACGGACCC |
| 7419 | SPBC3B8.11_DN | CGGCGGRGGAATTGGTGCAG | 7521 | SPBC3H7.15_DN | TCCGTCATCCCCATCCGICG |
| 7420 | SPBC3B9.01_UP | CAGTCAGCACTCAGGCTAGCA | 7522 | SPBC4.01_UP | ATCTTACACCGAGCGCCCCT |
| 7421 | SPBC3B9.01_DN | TGCCCGGTCCCTTCAACTGG | 7523 | SPBC4.01_DN | TAGTATGTCGGCGGGCGGTC |
| 7422 | SPBC3B9.02c_UP | GCCGGGGCTCAAGATGGGCTA | 7524 | SPBC4.02c_UP | ACCGAATACTGGCCGTGGGA |
| 7423 | SPBC3B9.02c_DN | CCACTGCTGAAGCGGCGGAG | 7525 | SPBC4.02c_DN | TCCTGCCGGTCCACTCCTCA |
| 7424 | SPBC3B9.04_UP | CTATCGCTTACACCGCCGCC | 7526 | SPBC4.03c_UP | GGAGGCATGACTGGGTGGGA |
| 7425 | SPBC3B9.04_DN | CCCAGCGCTACTTCGTTCCC | 7527 | SPBC4.03c_DN | GCTCAAGCCGGTGCAGGACG |
| 7426 | SPBC3B9.05_UP | GTCGTAGATCTTCGCCGCGC | 7528 | SPBC4.04c_UP | GAAGGCCGGCCAATCGACTT |
| 7427 | SPBC3B9.05_DN | CTCGGTGTTGTTGGCGCCC | 7529 | SPBC4.04c_DN | CTCGGGCCTATCACGCGCTC |
| 7428 | SPBC3B9.06c_UP | TGCGGGTATCGAACGGGAGT | 7530 | SPBC4.05_UP | AGGTCGGGGGGGGTTGGAAT |
| 7429 | SPBC3B9.06c_DN | TGCCCCGCACCAATACTACG | 7531 | SPBC4.05_DN | GGGGACTGGGTGGAGTGAGC |
| 7430 | SPBC3B9.07c_UP | ATGGGACTTTGGAGGGCGCA | 7532 | SPBC4.06_UP | CAAAATTACGTCGCCCCCCC |
| 7431 | SPBC3B9.07c_DN | TGAGCTTGCACCGCGATTGC | 7533 | SPBC4.06_DN | CCCACAGACCAAACCGCAAA |
| 7432 | SPBC3B9.08c_UP | CCCCTGTTTTGGTCCCTCTGC | 7534 | SPBC4.07c_UP | TCCGTTAAGCGGTCCTGCAT |
| 7433 | SPBC3B9.08c_DN | TCAACCAGACGATTCCCAGG | 7535 | SPBC4.07c_DN | GTTTTAGGGTCGTCCCACCGT |
| 7434 | SPBC3B9.09_UP | GGCGCACTACGGACAACCCC | 7536 | SPBC405.03c_UP | CCCGCCCACATTTCCACTGC |
| 7435 | SPBC3B9.09_DN | CTGCGTCCCTGGTCCCTCAT | 7537 | SPBC405.03c_DN | CGGATGGGTATTGCGAAGGG |
| 7436 | SPBC3B9.11c_UP | AGCTGCCTATGAGGTCGCAC | 7538 | SPBC405.04c_UP | TTCGGTCTTTCATGGCGCAG |
| 7437 | SPBC3B9.11c_DN | ACAGGCTAGCACCCTCCAT | 7539 | SPBC405.04c_DN | ACCACGCCGCATTCCACATA |
| 7438 | SPBC3B9.14c_UP | ACGATCCGTCCCGCTAGCCT | 7540 | SPBC405.05_UP | GCCGGCCTTTGGTGTACTGG |
| 7439 | SPBC3B9.14c_DN | GGGGTGAGAGCGACGGGTTAGG | 7541 | SPBC405.05_DN | AGGAGCTGGGCCGGGTAGTG |
| 7440 | SPBC3B9.15c_UP | GTTTTTGACTCGGCGCCTGG | 7542 | SPBC405.06_UP | TGATCTGGGGAAGCGAAGSG |
| 7441 | SPBC3B9.15c_DN | TGTGCCTACACACAGTGGGG | 7543 | SPBC405.06_DN | GGGGGATGAAGCAAACCTGG |
| 7442 | SPBC3B9.17_UP | CAAGCCTGCCGACCACCCAA | 7544 | SPBC405.07_UP | TTGAGCCCACGAAACGCCTG |
| 7443 | SPBC3B9.17_DN | AAGGGTGCGGATGAAGGACG | 7545 | SPBC405.07_DN | TTAGGACGCGCCCACTTTCA |
| 7444 | SPBC3B9.18c_UP | TCAAACACCGCTACGAACCA | 7546 | SPBC409.03_UP | CTGACGGGTCCGACGTACAA |
| 7445 | SPBC3B9.18c_DN | GGGGCAGGTAGATGGGCAGG | 7547 | SPBC409.03_DN | GCGTGAACCTGGGGAGAACC |
| 7446 | SPBC3B9.19_UP | GTTTTACGACCGCTGCCGCA | 7548 | SPBC409.05_UP | TCAGTTGCACGGCATTCCCG |

FIG.44

| Sequence number | Name | Base sequence | Sequence number | Name | Base sequence |
|---|---|---|---|---|---|
| 7549 | SPBC409.05_DN | CCGATATCTTTGGGGGCG | 7651 | SPBC4F6.07c_DN | GGCCACCGGACTTATCGCCC |
| 7550 | SPBC409.06_UP | CCTTTACCGCGGCCCAATTA | 7652 | SPBC4F6.08c_UP | TCCGCCCTCCCGAGCATCTA |
| 7551 | SPBC409.06_DN | GCCCCCCTCTGTCTGATGC | 7653 | SPBC4F6.08c_DN | ACCTCAGCCGTCGTCTCCCG |
| 7552 | SPBC409.07c_UP | TGGGCGGTTTCGGGGAGTAT | 7654 | SPBC4F6.09_UP | GGGTGCTGTGGTGGGAGAG |
| 7553 | SPBC409.07c_DN | GCGGTTCCTTTGGATSGGTA | 7655 | SPBC4F6.09_DN | CAATACCCGCACATCCGCAA |
| 7554 | SPBC409.08_UP | TGACCCCATCCGCCTCTTCC | 7656 | SPBC4F6.10_UP | GCCTGCGGAATTGGGGCTC |
| 7555 | SPBC409.08_DN | CCCGAGTCCCCTCGGTTCAC | 7657 | SPBC4F6.10_DN | ACGTAAGGCGGCGGGGAAAA |
| 7556 | SPBC409.09c_UP | TATTGGGCGCCGGTGGGATT | 7658 | SPBC4F6.11c_UP | TTGTCGGTCCTCTGCCGGTGT |
| 7557 | SPBC409.09c_DN | AAGTTACAGAGGGGGGGCGG | 7659 | SPBC4F6.11c_DN | GTGGAAAAGGCGGGGATGC |
| 7558 | SPBC409.10_UP | CAAAGACGTCCCGCAGCAAG | 7660 | SPBC4F6.12_UP | AACGGTCCGTAGGCTAAGCG |
| 7559 | SPBC409.10_DN | CCATCAGGGCGGTTACTGGG | 7661 | SPBC4F6.12_DN | ACCGATGAGTCCCCCCGATC |
| 7560 | SPBC409.11_UP | CTCCTCCCCCGCCGTCTAAA | 7662 | SPBC4F6.13c_UP | TCCGCCACGTTGCACCTATG |
| 7561 | SPBC409.11_DN | AGGCGGCAGGGTTCGATTGG | 7663 | SPBC4F6.13c_DN | CCTGGGGGGTATTTTCCGCT |
| 7562 | SPBC409.14c_UP | GGCTGAAAACGCATGCCCGGGT | 7664 | SPBC4F6.14_UP | ACGTCACGGTCCCCCACTTA |
| 7563 | SPBC409.14c_DN | CCCGCTTGATCATGTCCGCG | 7665 | SPBC4F6.14_DN | AGTTTGCACGGACTTGACCT |
| 7564 | SPBC409.15c_UP | CCCCTCACAATCTCGCTCCC | 7666 | SPBC4F6.15c_UP | GCGTCGCGTTACCTAAGCAC |
| 7565 | SPBC409.15c_DN | GGGGGCAAAAGAACCAGGC | 7667 | SPBC4F6.15c_DN | TGAGTCTAGTCCCGCCTCCGA |
| 7566 | SPBC409.17c_UP | CGGGGACCCAAAAACGAT | 7668 | SPBC4F6.16c_UP | GCTTAGCCGGCCAAACGATG |
| 7567 | SPBC409.17c_DN | ACACCCCTCACGTGTTCGCC | 7669 | SPBC4F6.16c_DN | TGTIGGGAGTGCGCCTGCTG |
| 7568 | SPBC409.18_UP | CAAACCACACATCCCGGCAC | 7670 | SPBC4F6.17c_UP | TGCTATGGACCGATCGGCGT |
| 7569 | SPBC409.18_DN | GCCCGCGCTGCCATACTTTA | 7671 | SPBC4F6.17c_DN | CCAGCGGAGCACCACGAATG |
| 7570 | SPBC409.19c_UP | TGCAGCAGTGGCCCAAGAAA | 7672 | SPBC4F6.18c_UP | GAGAGAGGGGCGGAACAT |
| 7571 | SPBC409.19c_DN | CGCAGGCGAATAGAAAGACG | 7673 | SPBC4F6.18c_DN | ACAGGCGTGGCAAGGTAGGC |
| 7572 | SPBC409.20c_UP | CCCCCTGCGCCATAAACGAC | 7674 | SPBC530.01_UP | GCCCCCAGGACCAGAAATGA |
| 7573 | SPBC409.20c_DN | CCCGAACCGCGATCCACTTT | 7675 | SPBC530.01_DN | CATCAGACCCCCTTGCCGTT |
| 7574 | SPBC409.21_UP | TTGGGGGGGAGGGTACTGT | 7676 | SPBC530.02_UP | TCCCCACCCACCCCTCTCAA |
| 7575 | SPBC409.21_DN | ACGTTTGGGTTGCGAGCGG | 7677 | SPBC530.02_DN | CATCCGACAAAAGCCCCACG |
| 7576 | SPBC418.02_UP | TCCCGCTCGRACGCCTGTAC | 7678 | SPBC530.03c_UP | TAGCAAAGCGGGAGCATCGG |
| 7577 | SPBC418.02_DN | AAAGCACAACGGAGCAGCGG | 7679 | SPBC530.03c_DN | GCAGCGCTGGAAACATGAAG |
| 7578 | SPBC428.03c_UP | ACCAAAAGCGCCCGAAGAAA | 7680 | SPBC530.04_UP | AAGCAGGACAGGAGCGGGGA |
| 7579 | SPBC428.03c_DN | CGTGGTGACGGCCGAATTGT | 7681 | SPBC530.04_DN | TCGCTGCTAATCCCCCTTG |
| 7580 | SPBC428.03c_UP | TCAGCTGTTGCCCTATCGAG | 7682 | SPBC530.05_UP | GAGCAAAGGCGGAAAGGCGG |
| 7581 | SPBC428.03c_DN | TGGTGCACGGAGCGACTTGT | 7683 | SPBC530.05_DN | AAAACGCCAACACTCGCCCA |
| 7582 | SPBC428.04_UP | ACGCAACGAGCCGAGTACCG | 7684 | SPBC530.06c_UP | ATGTGAACCCGCCTTTGCGC |
| 7583 | SPBC428.04_DN | TCCGGCGCTCCTTCAGTCA | 7685 | SPBC530.06c_DN | GGCTAGGCGCAGGAGGGCTT |
| 7584 | SPBC428.05c_UP | TTCGTCCCCGTTCTGCGGTT | 7686 | SPBC530.07c_UP | CGGCGTAGTGGGTGAGGCTG |
| 7585 | SPBC428.05c_DN | TGATCCCTTGACGGCTACCG | 7687 | SPBC530.07c_DN | CGGGCTGAAAGACATGGGG |
| 7586 | SPBC428.06c_UP | GCGGAATCGGGTGAAATGCG | 7688 | SPBC530.08_UP | CCTCAGGAACCCCACACGAAT |
| 7587 | SPBC428.06c_DN | GAGCTACACGGCGCGGGAAA | 7689 | SPBC530.08_DN | GCAGCAGGCGGATAGGAGA |
| 7588 | SPBC428.07_UP | ACGGACGGGCAACTCCAAAAT | 7690 | SPBC530.09c_UP | TTGCGGGGCTCTTGGATCGA |
| 7589 | SPBC428.07_DN | GGTCTCCTCCGCGGTTTGTC | 7691 | SPBC530.09c_DN | TCAAGACCCACGGCCTAGGA |
| 7590 | SPBC428.08c_UP | CCCAAGCCCCACCTCATCA | 7692 | SPBC530.10c_UP | CAEAACCGTCCGTCCCCGGCT |
| 7591 | SPBC428.08c_DN | GCGTTGGAATTGGCGTTTGGT | 7693 | SPBC530.10c_DN | GCGGCAGGTGATCGTGGTTC |
| 7592 | SPBC428.10_UP | GGTTAGCCGGGGTGATGAT | 7694 | SPBC530.11c_UP | ACACGAGACGCACCCATCCC |
| 7593 | SPBC428.10_DN | CGAAGGAGGCGTAGACCGA | 7695 | SPBC530.11c_DN | TCACACGAACCCGAAGCAGG |
| 7594 | SPBC428.11_UP | ATGCGGCGGGGGTTGTAGCT | 7696 | SPBC530.13_UP | CTCGTCCCTGCCTTGTGCCG |
| 7595 | SPBC428.11_DN | GTCGATCCAACACCGTCGCGA | 7697 | SPBC530.13_DN | TCTGCTCTGGGGCTGCTGTG |
| 7596 | SPBC428.12c_UP | AGCGGTACTCGACTGATCTT | 7698 | SPBC530.14c_UP | CAATCCACGCACAAATCCCG |
| 7597 | SPBC428.12c_DN | ATTGAGCCCAGGTGCGAAAC | 7699 | SPBC530.14c_DN | TCTCGACCCAGGTCGGTCGA |
| 7598 | SPBC428.13c_UP | ACCACGTGGGTAGCCTAACG | 7700 | SPBC543.02c_UP | CATGCCGCCACTCCGTGTAG |
| 7599 | SPBC428.13c_DN | GTGCCACCGGTACAACGTGT | 7701 | SPBC543.02c_DN | GCTGGGCGGATTCGGACGTT |
| 7600 | SPBC428.14_UP | AGGCAATAGGGCAAAGGCGG | 7702 | SPBC543.03c_UP | TTCATTTCGCTCACCGCCCG |
| 7601 | SPBC428.14_DN | TCTGTCTGGTGGCCCTGGT | 7703 | SPBC543.03c_DN | GGGGGCGGAAATGGAAACTC |
| 7602 | SPBC428.15_UP | ACACCATGCGCAAAGGGGCT | 7704 | SPBC543.04_UP | ACCGGCACCCCTCATGTTCA |
| 7603 | SPBC428.15_DN | TGCGTTGGTGCGTCGGTAAC | 7705 | SPBC543.04_DN | TGATGATGGGAACAGGGGGG |
| 7604 | SPBC428.17c_UP | TCCCTGCCCTTATACGTCAG | 7706 | SPBC543.05c_UP | CCAACCCCATCCCTTTTCCG |
| 7605 | SPBC428.17c_DN | ACGTTGATCTCCCTTTGTGC | 7707 | SPBC543.05c_DN | ACCAAGAATCCCCGTGTCCC |
| 7606 | SPBC428.18_UP | TTCGTTTAGTCCCACCGGGT | 7708 | SPBC543.06c_UP | AACATACGGTCGTGGCGGCT |
| 7607 | SPBC428.18_DN | AAGCTAGCGCGAGCGCTTAG | 7709 | SPBC543.06c_DN | CAACACGGCTACTCGCGCAG |
| 7608 | SPBC4B4.01c_UP | TCTGATTGGGTGGGGGCTGT | 7710 | SPBC543.07_UP | CATCGCAAATAACCCCCCGT |
| 7609 | SPBC4B4.01c_DN | TTGGATGGATTGGTACGGGG | 7711 | SPBC543.07_DN | GGGGACTGATGGGCAACGGAC |
| 7610 | SPBC4B4.02_UP | TGGATCTCAAGGCCTGCCGT | 7712 | SPBC543.08_UP | TGCTAAAACCACCGCCACGC |
| 7611 | SPBC4B4.02c_DN | CAGACGGGATGGCGTGATTG | 7713 | SPBC543.08_DN | ACGCCATGCCCCCACCAGAT |
| 7612 | SPBC4B4.03_UP | GCCGACGACTGCATGACCCA | 7714 | SPBC543.09_UP | GCGPACAGTAGAGGGGCGCA |
| 7613 | SPBC4B4.03_DN | TCACAAAGAGAGCCGGGCGA | 7715 | SPBC543.09_DN | AAGACGGACACACCCGCCCTG |
| 7614 | SPBC4B4.04_UP | CCCGCAGACCCTTTCCCAGT | 7716 | SPBC543.10_UP | GGCGCCCCCATCCTGGATCTT |
| 7615 | SPBC4B4.04_DN | GTTCGTCAGTGAACACCTCG | 7717 | SPBC543.10_DN | CGCGGCCCCTTATACGTCAG |
| 7616 | SPBC4B4.06_UP | GGGGGGAAGGGTCAGTTGGA | 7718 | SPBC557.02c_UP | TCAGTCATCGGCGGGCAATT |
| 7617 | SPBC4B4.06_DN | GAAAGCGGGTTGGGAGGGAC | 7719 | SPBC557.02c_DN | GTGGGTCGCCGTTGATTCGG |
| 7618 | SPBC4B4.07c_UP | TGAIAAGTCGACGCGCGGTT | 7720 | SPBC557.04_UP | GGCGACGGAGCAGCTAGGAG |
| 7619 | SPBC4B4.07c_DN | GCAGTGAGTCATTCGCGCTT | 7721 | SPBC557.04_DN | CCATAAGGATCGCGAACGGC |
| 7620 | SPBC4B4.08_UP | ACGTCATCCGTGAGGGGCTA | 7722 | SPBC557.05_UP | TCTGAGGGGGTCCGGTGTCG |
| 7621 | SPBC4B4.08_DN | TCTGTGCAGTGAGCACCTCG | 7723 | SPBC557.05_DN | AGCAGTATCGGCCGGCATTC |
| 7622 | SPBC4B4.09_UP | GGATTTCTTGCGAGGCCCG | 7724 | SPBC56F2.01_UP | CTGTTCGATCTCCCGCTCCG |
| 7623 | SPBC4B4.09_DN | CGGTTTGCATCGCCTCCCAA | 7725 | SPBC56F2.01_DN | TCCGGTTGGGGCTTGAGAAT |
| 7624 | SPBC4B4.10_UP | CGGCATTGGCGTGGTTTCCTA | 7726 | SPBC56F2.02_UP | ACTCGTGCCGGGTTGACTCG |
| 7625 | SPBC4B4.10c_DN | GCTATGGGGCTACTCGCGGA | 7727 | SPBC56F2.02_DN | CCCACTTATTCGGCCGAGCG |
| 7626 | SPBC4B4.12c_UP | ATCGAAACTGGGGGGCAAT | 7728 | SPBC56F2.03_UP | CCCTGTCTAGCTCCGCCCAT |
| 7627 | SPBC4B4.12c_DN | ACCTACGCGCGCTTGACACA | 7729 | SPBC56F2.03_DN | ATCGGGTGTATCGCACCGACA |
| 7628 | SPBC4C3.03_UP | TGGAGGTGGTCGGCGGCTA | 7730 | SPBC56F2.04_UP | ACATTACACCACCGGCGCCC |
| 7629 | SPBC4C3.03_DN | TTTGACGGGTTTCGGCAGCA | 7731 | SPBC56F2.04_DN | AACCCCGGAGCGTCAGGATA |
| 7630 | SPBC4C3.04_UP | TGTACACCCGCACAGCCCGT | 7732 | SPBC56F2.05c_UP | CTTCGCCCGCCACCTACCCT |
| 7631 | SPBC4C3.04c_DN | ATCCCAGCCCGCGTTGAAAG | 7733 | SPBC56F2.05c_DN | CGCACACCACCATCAACGGC |
| 7632 | SPBC4C3.05c_UP | TGCGTCCAATAGCTCCGCGG | 7734 | SPBC56F2.06_UP | GGGAAAGCCGAGACACAGGC |
| 7633 | SPBC4C3.05c_DN | GACTGGACCCGCCCAAACGA | 7735 | SPBC56F2.06_DN | GGCCCACGTAAATCGCGACA |
| 7634 | SPBC4C3.06_UP | GGCAACGGCAACTCCAATCG | 7736 | SPBC56F2.08c_UP | ACCACACTATGTCGTGGCCC |
| 7635 | SPBC4C3.06_DN | CGGAGGGTGGGTCGTGGATC | 7737 | SPBC56F2.08c_DN | AATCGGTGGTCGATTCTGG |
| 7636 | SPBC4C3.07_UP | CCCTCCGACTGCCTGCCTTT | 7738 | SPBC56F2.09c_UP | GGGACCAAGCGGGGAAGAAA |
| 7637 | SPBC4C3.07_DN | AGTCTCCCGTCCCCGCTCAAA | 7739 | SPBC56F2.09c_DN | CCAAGCCGGCAGCGAATCAG |
| 7638 | SPBC4C3.08_UP | CGCCATTTCTCACCCAACGC | 7740 | SPBC56F2.10c_UP | TCCCTCCGGCTCCATCCTTT |
| 7639 | SPBC4C3.09_DN | CGATCCCGTTTGCCTTGTGA | 7741 | SPBC56F2.10c_DN | CCGTGCTCTGCCTCGTTTCG |
| 7640 | SPBC4C3.09_UP | CGGATTGGCATTGGGTCGG | 7742 | SPBC56F2.11_UP | GTGGCGCCGGTTTCTTGTCA |
| 7641 | SPBC4C3.09_DN | GGACGGGAGCTTTGTGGGC | 7743 | SPBC56F2.11_DN | AACCGGCGCCCTCCTACTGC |
| 7642 | SPBC4C3.12_UP | AGTTCCGCGAGCGCAGTCA | 7744 | SPBC56F2.12_UP | ATGGGCGTTGTCGGATGTTG |
| 7643 | SPBC4C3.12_DN | IACCCGCGAGGACCAGGAAT | 7745 | SPBC56F2.12_DN | TGAGTTATTGGCGGCGGTT |
| 7644 | SPBC4F6.04_UP | GGGGCGGGAGGACTC | 7746 | SPBC56F2.14_UP | TGGTACTAGGTGGAACGGCG |
| 7645 | SPBC4F6.04_DN | CCCGGGAAGAAAGCGCATGT | 7747 | SPBC56F2.14_DN | TTGAGCGCATAGACTGCCGA |
| 7646 | SPBC4F6.05c_UP | TTCCTGGGTTTGGCCCTCTCG | 7748 | SPBC577.03c_UP | CTGGCCGCAACCGCAAATAC |
| 7647 | SPBC4F6.05c_DN | CGGCGCACAGTTTCGTTTGG | 7749 | SPBC577.03c_DN | CACGTCTGCGCGGTCTCACA |
| 7648 | SPBC4F6.06_UP | CCCGGCTAATCGCGCTAGGG | 7750 | SPBC577.05c_UP | CAGCCAGCCTCCATCACGTG |
| 7649 | SPBC4F6.06_DN | ACTGGCTAGGCAAGACGGGC | 7751 | SPBC577.05c_DN | TGCTTTCATTGCTGCGGGTT |
| 7650 | SPBC4F6.07c_UP | TTTATTGCTCGCCTCCGCGT | 7752 | SPBC577.06c_UP | CTATTCCTGCCCCCCCCTT |

| Sequence number | Name | Base sequence |
|---|---|---|
| 7957 | SPBC776.03_DN | TCGTCCCGCTCTTGCCTCTG |
| 7958 | SPBC776.04_UP | TGGGGGCGTGGAGTTAGGC |
| 7959 | SPBC776.04_DN | CCAGCCGATGTGCACTTTG |
| 7960 | SPBC776.05_UP | GTTCCGGGTGCGCTCCTTTA |
| 7961 | SPBC776.05_DN | CCCGAGATCACCAGACGCCC |
| 7962 | SPBC776.06c_UP | CCTGGTGCCTTTCCTTGCCG |
| 7963 | SPBC776.06c_DN | TCCTTCGCAGCGGTCTTTT |
| 7964 | SPBC776.07_UP | GCAGCCCGTCAGCTTCGTTG |
| 7965 | SPBC776.07_DN | CTTGAACGCCCTAGCCCCGA |
| 7966 | SPBC776.08c_UP | TTGGTCGAGGGCGGAGGGTA |
| 7967 | SPBC776.08c_DN | CCATGAGCGACGGCTTTTGA |
| 7968 | SPBC776.09_UP | CACGAAATGCCCCAACCCAT |
| 7969 | SPBC776.09_DN | TAGCCGATTTGTGGGGGACC |
| 7970 | SPBC776.11_UP | GGGTGCCACGGCTTGAAGAT |
| 7971 | SPBC776.11_DN | GCCGCCCTACGTCAAATGCT |
| 7972 | SPBC776.13_UP | AAGTAACCGCACGCCAATG |
| 7973 | SPBC776.13_DN | GACCCCGTTAGTTGGCCGA |
| 7974 | SPBC776.14_UP | TGGGGAATGCGCGGAACTCT |
| 7975 | SPBC776.14_DN | CACCTTTGTCGGCCGTCTCA |
| 7976 | SPBC776.15c_UP | CAATGGAAAGCACACCGCGG |
| 7977 | SPBC776.15c_DN | TCGGGCGCATGGATTACTG |
| 7978 | SPBC776.16_UP | GTCCGCTTCGCTCCTGTCCG |
| 7979 | SPBC776.16_DN | GACTCTCCGCGCACCAACAG |
| 7980 | SPBC776.17_UP | CATTGACCCAACACCACGCC |
| 7981 | SPBC776.17_DN | GGGGCTTCGGTGCGTTCGTA |
| 7982 | SPBC776.18c_UP | GGCTGCGAGCTGAAAGGGT |
| 7983 | SPBC776.18c_DN | CATAGCGCCCTCCCGAGTC |
| 7984 | SPBC800.02_UP | ACCGTCCACGAATCCGCACC |
| 7985 | SPBC800.02_DN | TCGGGAGAGCACACCGCGC |
| 7986 | SPBC800.03_UP | CGGCCAGATCGGGGGGTATA |
| 7987 | SPBC800.03_DN | CCGAAACGCCCCTGAAGTGCAT |
| 7988 | SPBC800.04c_UP | CTCCTCCGCCGCACGAAAAG |
| 7989 | SPBC800.04c_DN | GATTAAAGCGCGCCCGAGT |
| 7990 | SPBC800.05c_UP | GATGGGACGGATGCCTGGAT |
| 7991 | SPBC800.05c_DN | CAAGAGACTGCACGGCGCCC |
| 7992 | SPBC800.06_UP | AGGTTGAATAGCGCCACGGG |
| 7993 | SPBC800.06_DN | CAGAATGAGAGTCAGCGCGG |
| 7994 | SPBC800.07c_UP | TTGCGTGGGGGGACGAGGT |
| 7995 | SPBC800.07c_DN | CTGGCACAGCTTTGGACGGC |
| 7996 | SPBC800.08_UP | CCCCGGCCCAAGCCATTAAT |
| 7997 | SPBC800.08_DN | CGTGCGGCCTACCAAATTCC |
| 7998 | SPBC800.09_UP | CCTTGGGGGTATGCGTTTGG |
| 7999 | SPBC800.09_DN | CGGGAAGATCGACCACGACGG |
| 8000 | SPBC800.11_UP | TCTTTAATCCCAGCGCCGGT |
| 8001 | SPBC800.11_DN | TCTTTGTGCCGCTTCCGCC |
| 8002 | SPBC800.12c_UP | AACATTTGACGCGACGGGCT |
| 8003 | SPBC800.12c_DN | TCGGAGAGGCCGCAGAAACA |
| 8004 | SPBC800.13_UP | CGGCGCCCATGAAAAGAGTG |
| 8005 | SPBC800.13_DN | GGGGGAATAGCCGTTCGAATA |
| 8006 | SPBC83.01_UP | TATGGGGACGTGTTGGGGT |
| 8007 | SPBC83.01_DN | CATCAAACGGCGGAAGGGA |
| 8008 | SPBC83.02c_UP | TCACTAGCGCCGGCCCAAAA |
| 8009 | SPBC83.02c_DN | ATGATTCCCGACCCCCCTCG |
| 8010 | SPBC83.03c_UP | CAGCCGAGCGCCGAATTAGA |
| 8011 | SPBC83.03c_DN | CACCACTCCACGCATTCCGC |
| 8012 | SPBC83.05_UP | AAGCCCGCCTGTCTTACCCC |
| 8013 | SPBC83.05_DN | AAGGGCAACGGGACGGACA |
| 8014 | SPBC83.06_UP | ATTGGCGACGGGTCTTCAGG |
| 8015 | SPBC83.06_DN | TCCGCCCGTCGCAAAGAATG |
| 8016 | SPBC83.07_UP | AGAGATCCCGCCTGCCAACA |
| 8017 | SPBC83.07_DN | TCCGCCACGTCCACTTGAGA |
| 8018 | SPBC83.08_UP | CTGGGTGAAACGGCTGCTCC |
| 8019 | SPBC83.08_DN | GGGTAAATGCGCCGGTACGG |
| 8020 | SPBC83.09c_UP | TGGCGTCTCCCCTGTTGTGG |
| 8021 | SPBC83.09c_DN | TGGCAGATGGGGGCGTGGTA |
| 8022 | SPBC83.10_UP | GCCTCCACTGTCTCGGCGAT |
| 8023 | SPBC83.10_DN | TAGTACGGGCCTTTATCGCG |
| 8024 | SPBC83.12_UP | AATGGATGTTGACGCGGCG |
| 8025 | SPBC83.12_DN | GTGGACGGCGAGGTGTGGCT |
| 8026 | SPBC83.13_UP | TGATGTCTACAGGGCGGCGC |
| 8027 | SPBC83.13_DN | ACGGCGCTAAGCGAGTACC |
| 8028 | SPBC83.15_UP | CGGTGCGGGCGTCTCATACA |
| 8029 | SPBC83.15_DN | AAACCCCGGTAAGGCAAGCA |
| 8030 | SPBC83.16c_UP | GGGCCGCAGGATCAAGAATG |
| 8031 | SPBC83.16c_DN | AAGTGCCGGGGGTTGAGAG |
| 8032 | SPBC83.17_UP | GTGGGCCAAGGGGCGATGTA |
| 8033 | SPBC83.17_DN | AGTTCCGCTCACGCTCCCTG |
| 8034 | SPBC83.18c_UP | GCCTTGTCACTGCCCGAACC |
| 8035 | SPBC83.18c_DN | GGTCGATGTTGGGTCAAGCA |
| 8036 | SPBC83.19c_UP | TTGCCCGGATAATAGGCAGCG |
| 8037 | SPBC83.19c_DN | ATTATGCGGACCACGGGACC |
| 8038 | SPBC839.02_UP | TCAACGGCAGGAAAGGGCGA |
| 8039 | SPBC839.02_DN | CCGGTTATTGGCGTGCTCGA |
| 8040 | SPBC839.03c_UP | GATTTCGGCCGCGGGATACT |
| 8041 | SPBC839.03c_DN | AAGGTCCGGCACAGAGGGAAC |
| 8042 | SPBC839.04_UP | CATGCGGCGTGCGAGGAATC |
| 8043 | SPBC839.04_DN | CCACACGGCCTCGGACTTCA |
| 8044 | SPBC839.05c_UP | GAGAGAGGGAAATCGGGCCG |
| 8045 | SPBC839.05c_DN | GGCTCATTGCTTGTGCGACG |
| 8046 | SPBC839.06_UP | TTCATTATTCGGGGGGCA |
| 8047 | SPBC839.06_DN | AGGAAACAACAAGGGCGGG |
| 8048 | SPBC839.07_UP | ACGGAATGAAAGGGCCACGG |
| 8049 | SPBC839.07_DN | ATACTTATCGGACGCGCGGG |
| 8050 | SPBC839.08c_UP | ATTTGGTGCAGGACGGTGGC |
| 8051 | SPBC839.08c_DN | GTTACAGAGCGGGAACCCCA |
| 8052 | SPBC839.09c_UP | TTCAGTGCGTTCGGGGCTTA |
| 8053 | SPBC839.09c_DN | AAAAAGAGTGGCCGCGAAGCC |
| 8054 | SPBC839.11c_UP | GGGGCGGTTCTTTGAGTTGC |
| 8055 | SPBC839.11c_DN | TGCCCCGCGTGTCTCTCGTTG |
| 8056 | SPBC839.13c_UP | AGGACATCACGGACTACGCGG |
| 8057 | SPBC839.13c_DN | CGAGCCCGAGATTGCCTGCAC |
| 8058 | SPBC839.15c_UP | GCAGCCACTCCCTATCCCCG |
| 8059 | SPBC839.15c_DN | TCGGGATCAGCCAGTCGTTG |
| 8060 | SPBC839.16_UP | TGACCTCCGCGACTGCAATT |
| 8061 | SPBC839.16_DN | CGAACGAATTGGGCCGAGGT |
| 8062 | SPBC839.17c_UP | CGGCACCGCGGATAATTGTC |
| 8063 | SPBC839.17c_DN | GCGGGCCTTGCCATGACTTT |
| 8064 | SPBC887.01_UP | TGTTTATCGGCGGGGGGCCT |
| 8065 | SPBC887.01_DN | ATAGCGCGAGGTCACAGGGC |
| 8066 | SPBC887.02_UP | AGGGCGGGCTGGAGGATGAG |
| 8067 | SPBC887.02_DN | TTCTGCCCTTTACCCAGCCG |
| 8068 | SPBC887.05c_UP | ACTCTTGGCCGATCTGCGTG |
| 8069 | SPBC887.05c_DN | ATCTCTCGGGATAGACGGCCA |
| 8070 | SPBC887.06c_UP | GGCCCTCTTCACGCAATCCG |
| 8071 | SPBC887.06c_DN | TACAGGAGGGGACCGGCGAG |
| 8072 | SPBC887.07_UP | CTGGGCTAGTCGGCAAGGG |
| 8073 | SPBC887.07_DN | ATGATCCGCCAACCAGCACG |
| 8074 | SPBC887.10_UP | CCTATTCGGTTCCTCTGCCC |
| 8075 | SPBC887.10_DN | GTTTGCCGCTTTCGCCTGTG |
| 8076 | SPBC887.11_UP | GCCTGACGGCCTACGCCAAA |
| 8077 | SPBC887.11_DN | GGCGGGGTGAGGGGAGAATT |
| 8078 | SPBC887.12_UP | GCGAAAGGCGAAATAGCGGT |
| 8079 | SPBC887.12_DN | AGTGGGGGACGGACGGCAAC |
| 8080 | SPBC887.15c_UP | AATACCACACGGAAGCGCCCG |
| 8081 | SPBC887.15c_DN | TCTCCCCGCAGCCACACCTT |
| 8082 | SPBC887.16_UP | TGTGGTATGAAGCGCGGGAG |
| 8083 | SPBC887.16_DN | GCAGGCTTATTTTTCGCGGC |
| 8084 | SPBC887.17_UP | CGCCCTGCAACGCTCACTCC |
| 8085 | SPBC887.17_DN | TGGATCGCCGTCAACAGGGA |
| 8086 | SPBC887.18c_UP | TGCGGCAACAGGAACTTGCA |
| 8087 | SPBC887.18c_DN | TCCGTTGGGAATCACGGTGG |
| 8088 | SPBC887.19_UP | CCCGAACCCCCGATGAGATGG |
| 8089 | SPBC887.19_DN | CAACAAGCCCTTCCCCGTGAT |
| 8090 | SPBCD2.09c_UP | CCGGCAATCGGGTTCCACTA |
| 8091 | SPBCD2.09c_DN | GCCGACAGTTCACGCGACTA |
| 8092 | SPBCD2.10c_UP | GCTCACGAACTCGCCAAAAA |
| 8093 | SPBCD2.10c_DN | GAAGTGATGGACGGCAGGCA |
| 8094 | SPBCD2.16c_UP | TCTAATCGGAATCGCCACGCC |
| 8095 | SPBCD2.16c_DN | CAAAAGCGACTGCCCCCGAA |
| 8096 | SPBCD2.17_UP | CGACAGGAGGCCGGAAAAGC |
| 8097 | SPBCD2.17_DN | AAGCAACTTCCGGCCTCGCA |
| 8098 | SPBCD2.18c_UP | GGTGGAGGCCGTGAATTGCA |
| 8099 | SPBCD2.18c_DN | AGCTTTTTGATCCATGCGGG |
| 8100 | SPBCD2.19_UP | CACCTCTATGCGATCCGGCC |
| 8101 | SPBCD2.19_DN | CGCCGCGTTTTGTTCAGCTC |
| 8102 | SPBCD2.20c_UP | GCGAAGAAAATGGCAGGGCG |
| 8103 | SPBCD2.20c_DN | CTTCCTCACCCCTCCCAACG |
| 8104 | SPBCE4.02c_UP | GCCCCGTAGCTGCGAAAGAG |
| 8105 | SPBCE4.02c_DN | GCGCGGGTAGGTGCGTGTGA |
| 8106 | SPBCE4.03_UP | CCCCCGTTTCCCTGGCACTA |
| 8107 | SPBCE4.03_DN | AGCGGGGTGAGGTACGAAAG |
| 8108 | SPBCE4.04_UP | GCGGATGCTACGAATTGGCG |
| 8109 | SPBCE4.04_DN | GCTTGGCCGGAGGGGTACAC |
| 8110 | SPBCE4.05c_UP | AACGCTTCCGGCCCTAGACG |
| 8111 | SPBCE4.05c_DN | CGACTTCCGCATCTCCCCAC |
| 8112 | SPBC902.02c_UP | GACTCTGCGCGCTCCAICGG |
| 8113 | SPBC902.02c_DN | TGGGATCTACGGCCCTTGGG |
| 8114 | SPBC902.03_UP | CTCCCGCAACCGATCAGCTG |
| 8115 | SPBC902.03_DN | TTGTTCCATTACAGGCGTGCT |
| 8116 | SPBC902.04_UP | TTAGGGCAGCAGGCGGAGGG |
| 8117 | SPBC902.04_DN | GTTCGGGTTCCTTGCCTTGC |
| 8118 | SPBC902.05c_UP | AACACACCGCCCAGCCATCG |
| 8119 | SPBC902.05c_DN | AGGTTGGGGTCGACTGTGGC |
| 8120 | SPBC902.06_UP | GGTTTCGGCCGCTAGGTGTC |
| 8121 | SPBC902.06_DN | TCGACCCGCATATCCCCCAG |
| 8122 | SPBC947.01_UP | GGCCAAAACAAGCACCGCAA |
| 8123 | SPBC947.01_DN | GAAACGCAGGCGTGGGCGAT |
| 8124 | SPBC947.02_UP | CCAATCTGTGCTCTCCGCGA |
| 8125 | SPBC947.02_DN | CGTCGGCCAGGTTGCAAGG |
| 8126 | SPBC947.03c_UP | GGCGGTAAGATTGGCGAAGC |
| 8127 | SPBC947.03c_DN | GTGGGGCAATCGGCAAAAAG |
| 8128 | SPBC947.04_UP | ACACCCGGCATTCACCCACG |
| 8129 | SPBC947.04_DN | GTTTGGGTTGGAGTGCGTCT |
| 8130 | SPBC947.05c_UP | GCGCCCTCGHTTGGTACCCC |
| 8131 | SPBC947.05c_DN | TGATCGTATTTGCAGGGCGC |
| 8132 | SPBC947.06c_UP | GCGGAGGGAAGGGTTGTGTC |
| 8133 | SPBC947.06c_DN | CACGAACTAAGCCAACGGCG |
| 8134 | SPBC947.07_UP | GGGGGGGCTGCTCTAGTTTG |
| 8135 | SPBC947.07_DN | AAAACTGCATGCGCCGTCGA |
| 8136 | SPBC947.08c_UP | TGGGCGGTTCGGGTGTTGAC |
| 8137 | SPBC947.08c_DN | CCGCTTTCCCGCCTTGACTA |
| 8138 | SPBC947.09_UP | GGACAAATGCGGGAAGGGAA |
| 8139 | SPBC947.09_DN | GCTCAATCGCCCCCATTCT |
| 8140 | SPBC947.10_UP | TATCCCGCCTTGAGCCGTTT |
| 8141 | SPBC947.10_DN | GTGGGGGAGGGGACTGTGAA |
| 8142 | SPBC947.11c_UP | ACCGATTACCTTGCGCCTGG |
| 8143 | SPBC947.11c_DN | TAGCGCATCAACCCACACGG |
| 8144 | SPBC947.12_UP | CCCGCACAGATCGCACGAAA |
| 8145 | SPBC947.12_DN | CGCCCTAAGCACAACACAAA |
| 8146 | SPBC947.13_UP | GACCGACCCCTCCCAGCCTC |
| 8147 | SPBC947.13_DN | GGACACCCCGGAAAGAGCAG |
| 8148 | SPBC947.15c_UP | CAAAGTGCGGCTAATCCCC |
| 8149 | SPBC947.15c_DN | GACATGCAAATACGCCGCCC |
| 8150 | SPBC9B6.02c_UP | GTGGAGGGCAGGCAGGAAG |
| 8151 | SPBC9B6.02c_DN | AGGGGACGAAGGCACCAGGG |
| 8152 | SPBC9B6.03_UP | AAACACCCACGCCAAACCCT |
| 8153 | SPBC9B6.03_DN | TGTTGGGTCTGGTGCGAAGG |
| 8154 | SPBC9B6.04c_UP | GCTTGTCGGCATGTACCCGG |
| 8155 | SPBC9B6.04c_DN | TCTAACGGTCTGCCCCGCGC |
| 8156 | SPBC9B6.06_UP | ACGGAGGCACAGCGGGGATCA |
| 8157 | SPBC9B6.06_DN | CCTACCCCTGCGTGCCGTTC |
| 8158 | SPBC9B6.07_UP | GCAGCGAGAGGAGGGCAACT |
| 8159 | SPBC9B6.07_DN | CACCGAAGCGAGCACCCGTT |
| 8160 | SPBC9B6.09c_UP | GTCGCGGCTGGCATCTTGTT |

FIG.47

| Sequence number | Name | Base sequence |
|---|---|---|
| 8161 | SPBC9B6.09c_DN | TGCTAGCAGCCCCTCCCGAC |
| 8162 | SPBC9B6.10_UP | CCTTCCGCATGCCCAGGTAC |
| 8163 | SPBC9B6.10_DN | GTGGAACCCAGTGGCTGCAA |
| 8164 | SPBC9B6.11c_UP | GGGCGCTTGTCTCGGTTGTG |
| 8165 | SPBC9B6.11c_DN | GGGGTACGCCTGGTGCAATT |
| 8166 | SPBCPT2R1.01c_UP | GCCTACGTCGCTCCCCTGCC |
| 8167 | SPBCPT2R1.01c_DN | ATGGAGAGATGGCGACGGCG |
| 8168 | SPBCPT2R1.02_UP | CAGCACCGTGATCCGACACT |
| 8169 | SPBCPT2R1.02_DN | CTACATGCGTCGCACTGGCA |
| 8170 | SPBCPT2R1.08c_UP | TCACGTCGGTCGAAGCAGTC |
| 8171 | SPBCPT2R1.08c_DN | ACACTGCAGGTAGGGCGCAA |
| 8172 | SPBP16F5.03c_UP | CCATCCGGGTCCAAATCGAA |
| 8173 | SPBP16F5.03c_DN | GGGTGCTTGTGGGCGGATTT |
| 8174 | SPBP16F5.04_UP | TTGCCTCTCTGCCTCGCACC |
| 8175 | SPBP16F5.04_DN | CTGGAACAGCCCCCCTTGGA |
| 8176 | SPBP16F5.05c_UP | AGCACGTCCCATCAGCACCG |
| 8177 | SPBP16F5.05c_DN | CAAACCCAAGAAAGCGCCCA |
| 8178 | SPBP16F5.06_UP | TACCAAAGGGCGACATGGGC |
| 8179 | SPBP16F5.06_DN | TGCCATTGCCGATAAAGCGG |
| 8180 | SPBP16F5.08c_UP | CCCGAGGGGGTGGTAGGTGT |
| 8181 | SPBP16F5.09c_DN | CCTTCGGTAGGAGCCCTGGC |
| 8182 | SPBP18G5.03_UP | ACGCAACACCCAATCATCCG |
| 8183 | SPBP18G5.03_DN | TACTTGCTTTGCGGGCCTCG |
| 8184 | SPBP19A11.01_UP | ATGTTCCATTGAGCGCCCCG |
| 8185 | SPBP19A11.01_DN | GTTTTCCCCGGCTGACCTGC |
| 8186 | SPBP19A11.02c_UP | GCCAGTGGCTGGTTCCTGCAA |
| 8187 | SPBP19A11.02c_DN | GGGCCCACAAAAAAAAGCGCA |
| 8188 | SPBP19A11.04c_UP | GTCATTTCGGGGTCGGCAAG |
| 8189 | SPBP19A11.04c_DN | GGTCGGGGGAAAGGGAATGT |
| 8190 | SPBP22H7.02c_UP | GCGCTAGTGGATGGGCAGAG |
| 8191 | SPBP22H7.02c_DN | CGGCGAACGAACGACTGGAC |
| 8192 | SPBP22H7.04_UP | TCCACGTCCCCCCGCTACC |
| 8193 | SPBP22H7.04_DN | GCCGCGCCGTCAAGTGTTCAG |
| 8194 | SPBP22H7.05c_UP | GACCTCCACACACCCTGCC |
| 8195 | SPBP22H7.05c_DN | CGGGGGGTCAGTAGACGTG |
| 8196 | SPBP22H7.06_UP | CAGACACTCGCGGCCAAAAT |
| 8197 | SPBP22H7.06_DN | TCGCCGGCTTCGTCATCTTT |
| 8198 | SPBP22H7.09c_UP | ACAGCCATGCGTACGTGGGT |
| 8199 | SPBP22H7.09c_DN | ACGCGGCCGATCTAAGGGTA |
| 8200 | SPBP23A10.02_UP | CCGTAACGCCCATGCAACGC |
| 8201 | SPBP23A10.02_DN | TCCCAGCCCCAGCTACCAGA |
| 8202 | SPBP23A10.03c_UP | GCAGAGTGACCCCGCCAAG |
| 8203 | SPBP23A10.03c_DN | AGCAAATGGTGTCCGCGCAG |
| 8204 | SPBP23A10.05_UP | TGTGGAGAAGCGTGATGCGG |
| 8205 | SPBP23A10.05_DN | ACTGATGAAAGCACCGCGGC |
| 8206 | SPBP23A10.06_UP | TCTGGATCAGCGCAGGGCTT |
| 8207 | SPBP23A10.06_DN | TTGGCACAATGGGGGTTCCG |
| 8208 | SPBP23A10.07_UP | ATGATCCACCAAACCGGCCG |
| 8209 | SPBP23A10.07_DN | GCCTGCCACGATTCGACCCA |
| 8210 | SPBP23A10.08_UP | GGGAGTCGATGCGCGCTTTGC |
| 8211 | SPBP23A10.08_DN | TCATAGGAACGGGGCTGCGT |
| 8212 | SPBP23A10.10_UP | CCGCTCTCGCGTTTTCACAG |
| 8213 | SPBP23A10.10_DN | CGGACCACTCCACACACCCG |
| 8214 | SPBP23A10.12_UP | TGAAGGGGGGGCTACGCTGA |
| 8215 | SPBP23A10.12_DN | TGATGATGGGTCTTGCGGGA |
| 8216 | SPBP23A10.13_UP | TCGGAAGACACACCATCGGG |
| 8217 | SPBP23A10.13_DN | GTGTGTGGTCGGTGCGTCGG |
| 8218 | SPBP23A10.14c_UP | CAACCGGCCACACATTTCCC |
| 8219 | SPBP23A10.14c_DN | TTGCCCGCGGAGGTATCGTA |
| 8220 | SPBP23A10.15c_UP | ACTCGAACTGCATGGGGACA |
| 8221 | SPBP23A10.15c_DN | GTAGACGGTTGGGGGAGGCG |
| 8222 | SPBP23A10.16_UP | CGGGGGTTGTCATTCGGTCG |
| 8223 | SPBP23A10.16_DN | CCCCCGACGCGTTTATCCTT |
| 8224 | SPBP26C9.02c_UP | CGATGGGAGGGCGGTAGCTA |
| 8225 | SPBP26C9.02c_DN | CATTCGAAGAGCCAACCGGC |
| 8226 | SPBP26C9.03c_UP | TGTGGGCGGAGTGTGTGCTC |
| 8227 | SPBP26C9.03c_DN | TGGAGTGTATTGGGGGGGA |
| 8228 | SPBP35G2.02_UP | GCCCTCCTACACCTGCCGTC |
| 8229 | SPBP35G2.02_DN | AGCACACGAAACACAGGCGG |
| 8230 | SPBP35G2.03c_UP | AATTCCCGACCTGCCCACCC |
| 8231 | SPBP35G2.03c_DN | AGACCGGGGCACTTAGGCAG |
| 8232 | SPBP35G2.04c_UP | CCAGTTGCCCTCAGCCGTCT |
| 8233 | SPBP35G2.04c_DN | AGAAAAGGGAGAGGGCGGA |
| 8234 | SPBP35G2.05c_UP | ACGGACCACACCCCTCGTC |
| 8235 | SPBP35G2.05c_DN | GGCAAGGACATCGGGTGGAA |
| 8236 | SPBP35G2.06c_UP | ACATCCGCGTACTGCTCCCA |
| 8237 | SPBP35G2.06c_DN | TCGCTACGGGTCTGACTTCG |
| 8238 | SPBP35G2.07_UP | ACACAGGGGTTGGGCGGGAC |
| 8239 | SPBP35G2.07_DN | GGTTGAAGTGGAGTGGGGCT |
| 8240 | SPBP35G2.08_UP | TCCCCAATCCGCATCACGA |
| 8241 | SPBP35G2.08c_DN | AAGCCACCCGCCTGCCAAAT |
| 8242 | SPBP35G2.10_UP | CGCGGGATTGCATTGTGTGA |
| 8243 | SPBP35G2.10_DN | CGAGGGAGTGGAGTGGGGGC |
| 8244 | SPBP35G2.11c_UP | GCGGGTAACTTGGCGGTCGT |
| 8245 | SPBP35G2.11c_DN | CCGGTGCGAGAACCCTTTA |
| 8246 | SPBP35G2.12_UP | GGCGTTGGGGGGGACTACA |
| 8247 | SPBP35G2.12_DN | GGCAGGACCGCAACCACCCT |
| 8248 | SPBP35G2.13c_UP | CCTGCCCCTAAAACCCGTGC |
| 8249 | SPBP35G2.13c_DN | TTTCCCCCGGTTCGTTCAA |
| 8250 | SPBP35G2.14_UP | TCGCCGTGTCTGAAGCGCTAT |
| 8251 | SPBP35G2.14_DN | GCGAGGCTTATGTCCGGTGA |
| 8252 | SPBP4G3.02_UP | TCATGACCTCGCGTCTCGCG |
| 8253 | SPBP4G3.02_DN | GGGTTGAGGGTACGGTTGCG |
| 8254 | SPBP4G3.03_UP | GCCGAGAACGGCGAACACCT |
| 8255 | SPBP4G3.03_DN | CGCGCGAGATACGAATGAGG |
| 8256 | SPBP4H10.03_UP | TGATGGGGTCCAGGGAAACC |
| 8257 | SPBP4H10.03_DN | GCAACCCACCGTACGAAGGC |
| 8258 | SPBP4H10.04_UP | GCGATTTGCATGGACGCGTA |
| 8259 | SPBP4H10.04_DN | TAGGCAAACCGGGCACACAC |
| 8260 | SPBP4H10.05c_UP | GCCAGGGGAGGAGCAACAA |
| 8261 | SPBP4H10.05c_DN | AGAGGATCCATAGCCGGCCA |
| 8262 | SPBP4H10.07_UP | CGGCGCCACACTCCCTAATC |
| 8263 | SPBP4H10.07_DN | TTGCTGCGCGGTTAAAGTGG |
| 8264 | SPBP4H10.09_UP | ACTCCCGTCCGCGTTCAATG |
| 8265 | SPBP4H10.09_DN | CACGGGCTGGATGACGGAGG |
| 8266 | SPBP4H10.10_UP | TAGACGGGATCCCAAGGGCG |
| 8267 | SPBP4H10.10_DN | TCAGGGCGTCAGGGTCACAA |
| 8268 | SPBP4H10.11c_UP | GGATTAACCCGGGCCCTGAC |
| 8269 | SPBP4H10.11c_DN | CGGCCCCTGGAACTTTTGGT |
| 8270 | SPBP4H10.13_UP | GCGGCAATGAGGGGGAGTT |
| 8271 | SPBP4H10.13_DN | AACCGGTGTCCCCCATGAAG |
| 8272 | SPBP4H10.14c_UP | CCTAGACCCTCCAATCGCGG |
| 8273 | SPBP4H10.14c_DN | ACGGGGCTTTCGTGCTTGTT |
| 8274 | SPBP4H10.16c_UP | CTACCCGCCGCCCCTTAGTT |
| 8275 | SPBP4H10.16c_DN | AAGGCGATAGGGGTGAGCA |
| 8276 | SPBP4H10.17c_UP | CCGCAATACGTCACAGCAGC |
| 8277 | SPBP4H10.17c_DN | CCTTTCGACTTCCCATCCCGC |
| 8278 | SPBP4H10.18c_UP | CATCCCGCCCTGAGACCTTG |
| 8279 | SPBP4H10.18c_DN | ACCGCCCTGCCACTGTTAGC |
| 8280 | SPBP4H10.19c_UP | TGTTACAGCGGGCCGTACAA |
| 8281 | SPBP4H10.19c_DN | CACTCGTTCCGACACGGACT |
| 8282 | SPBP4H10.20_UP | TACCTGGGAACTGCGGCCTT |
| 8283 | SPBP4H10.20_DN | GCCGAGCGCAGAGTACCCGC |
| 8284 | SPBP4H10.21c_UP | GGTGCGGGATGGTACGGTG |
| 8285 | SPBP4H10.21c_DN | AAGTACTGCTGCGCCCCGG |
| 8286 | SPBP8B7.02_UP | CGGTTCGAGGTGTGAGGCGC |
| 8287 | SPBP8B7.02_DN | AATGGGGAACTTTGGCGTG |
| 8288 | SPBP8B7.04_UP | CAGCTCCGTGACGGCGAATTA |
| 8289 | SPBP8B7.04_DN | ATGGTTCCCCCTGTTTGCCC |
| 8290 | SPBP8B7.05c_UP | AACGGTCAGGGGTCGGCGTC |
| 8291 | SPBP8B7.05c_DN | CTCAAGGATCGGGGCGCTA |
| 8292 | SPBP8B7.06_UP | CCCCCTCCGGGTTTTTGAGT |
| 8293 | SPBP8B7.06_DN | GGCAAACGGGGCAGAGGGTA |
| 8294 | SPBP8B7.07c_UP | TTTACGGGGTGCGCTTTCCA |
| 8295 | SPBP8B7.07c_DN | TTCACAAGCGAGCCGTCACC |
| 8296 | SPBP8B7.08c_UP | TTCTCTGTCGCCCCCACCGT |
| 8297 | SPBP8B7.08c_DN | TGTACGTCATCCTCCGGCCC |
| 8298 | SPBP8B7.09c_UP | ACCGCAAGAGGTGGCCAATC |
| 8299 | SPBP8B7.09c_DN | TCTCCACCCGCGGTAGATCA |
| 8300 | SPBP8B7.10c_UP | ACGTCACCCAACCAGCCTCC |
| 8301 | SPBP8B7.10c_DN | TACCGGCCGAAGAAGCAAGG |
| 8302 | SPBP8B7.11_UP | GCGCACTCCAGTGCAGGAGA |
| 8303 | SPBP8B7.11_DN | GTCGACTCGGCATGTGCCAT |
| 8304 | SPBP8B7.13_UP | CGCATTTCAACCCCCTCGCT |
| 8305 | SPBP8B7.13_DN | CAGCGCCTTCATTCCCCGTG |
| 8306 | SPBP8B7.14c_UP | TGGCGATATGCACGTAGCGT |
| 8307 | SPBP8B7.14c_DN | GGGCTCGGGGTTTAGCGTT |
| 8308 | SPBP8B7.15c_UP | AGAGGCTTGGGGATGGTCG |
| 8309 | SPBP8B7.15c_DN | AGGGGAATGGTTCTGGGCGT |
| 8310 | SPBP8B7.16c_UP | GGGTAAGCAGGCAAGCGGGT |
| 8311 | SPBP8B7.16c_DN | TGCCCGAACCCCCATTTTAG |
| 8312 | SPBP8B7.17c_UP | AACCTGGGCTTCCGTAGGGT |
| 8313 | SPBP8B7.17c_DN | ATGGGGCTGGGGTCGGAAAC |
| 8314 | SPBP8B7.18c_UP | TGATCACGGAGCCCAACGCC |
| 8315 | SPBP8B7.18c_DN | TTAGCTGCGTGGGCCCTTGT |
| 8316 | SPBP8B7.19_UP | TAAGGGCGGTGGCTGGAAGC |
| 8317 | SPBP8B7.19_DN | TTCGGTCGCTGGGTCGTCTT |
| 8318 | SPBP8B7.20c_UP | CGCCGGGCCCTTACGACAAC |
| 8319 | SPBP8B7.20c_DN | CCCTCCCCAAGGCCCATCAG |
| 8320 | SPBP8B7.21_UP | TCAGCCCGTCATCACGCGTT |
| 8321 | SPBP8B7.21_DN | CTACGCGCCCTTTCCACCAA |
| 8322 | SPBP8B7.23_UP | CCCCAGCCAGTAAAAGCCAG |
| 8323 | SPBP8B7.23_DN | ATGAGGGTGGGGGTCCGTTG |
| 8324 | SPBP8B7.24c_UP | ACTGGGCAAGGCAATGGGAA |
| 8325 | SPBP8B7.24c_DN | AGGTCCCCCACCCGTACCAA |
| 8326 | SPBP8B7.25_UP | CGGCTGCTCCACGAAGCTAG |
| 8327 | SPBP8B7.25_DN | TCCGACACCCCCACCGTAAG |
| 8328 | SPBP8B7.27_UP | CTCTTGGGGTTGGATGGCCG |
| 8329 | SPBP8B7.27_DN | AGACGCGGGGGATTTTTGTG |
| 8330 | SPBP8B7.28c_UP | CCTATCGGCCCCTTCGTTCA |
| 8331 | SPBP8B7.28c_DN | CAAAGCAAGTCCCCCGTCCC |
| 8332 | SPBP8B7.30c_UP | GAAGGTGGCGACAAACGGA |
| 8333 | SPBP8B7.30c_DN | GTGCTTCTTCGTGGTGGCGG |
| 8334 | SPBPB10D8.01_UP | GGGGGAAGGCGAAAAGCAGA |
| 8335 | SPBPB10D8.01_DN | GGCAGAGGTGACGGCAAGCG |
| 8336 | SPBPB10D8.02c_UP | GCCGGCCACCACACAGTCAA |
| 8337 | SPBPB10D8.02c_DN | ACGCCAGCCCTCACATTTG |
| 8338 | SPBPB10D8.04c_UP | TTTCCCCATCCCTCGCCCTG |
| 8339 | SPBPB10D8.04c_DN | AGGAGGGGCAATGTGAGGC |
| 8340 | SPBPB10D8.05c_UP | TGCGGGAGGGACAGGGGTAA |
| 8341 | SPBPB10D8.05c_DN | TAGGAGTGTGCGGGGACGGG |
| 8342 | SPBPB10D8.06c_UP | AAGCGGGGGTTAGGAGGCTG |
| 8343 | SPBPB10D8.06c_DN | ACGTTCTTTGCGGCCGGGTC |
| 8344 | SPBPB10D8.07c_UP | TACGACGTAGTCACCGCGTG |
| 8345 | SPBPB10D8.07c_DN | TTCACGCCCCCCTATACCGC |
| 8346 | SPBPB21E7.01c_UP | CCGTGCGATCGCCTGAGTAA |
| 8347 | SPBPB21E7.01c_DN | AGTAATGCACGCTGCGCAAG |
| 8348 | SPBPB21E7.05_UP | CCCAGTGCCGATTGACCTCT |
| 8349 | SPBPB21E7.05_DN | ATCCCGACCTCTAGGCGGTA |
| 8350 | SPBPB21E7.09_UP | TCAGCCGCTGTGAGGTCCAA |
| 8351 | SPBPB21E7.09_DN | TAGAGAGCGGCTGTCACGCA |
| 8352 | SPBPB2B2.01_UP | CCCTCCACCCTGTCCACCG |
| 8353 | SPBPB2B2.01_DN | TGGTTGCCGACTTTCGTCCCG |
| 8354 | SPBPB2B2.02_UP | TGCTGCTCTGTGACGGTACG |
| 8355 | SPBPB2B2.02_DN | GTCATGACGAAGCTCGGTCCA |
| 8356 | SPBPB2B2.05_UP | CTCACGTGCGCGGCATTTAA |
| 8357 | SPBPB2B2.05_DN | CTTCTGCCCTGCTCGTCCCG |
| 8358 | SPBPB2B2.06c_UP | TGTGGCGAGCGCTGTTTTA |
| 8359 | SPBPB2B2.06c_DN | CGGAGCTCGCCTTTGGTCAT |
| 8360 | SPBPB2B2.07c_UP | CGAGGGAGAGTTTGGCGGCAG |
| 8361 | SPBPB2B2.07c_DN | TCTGCGCCAAAATCTCCCGG |
| 8362 | SPBPB2B2.08_UP | CGAATCGGCCGAGGGTAAGCT |
| 8363 | SPBPB2B2.08_DN | GGGCGGCGGTTGTGTTGTT |
| 8364 | SPBPB2B2.09c_UP | TCCACCTTAATCCCGCGGCC |

FIG.48

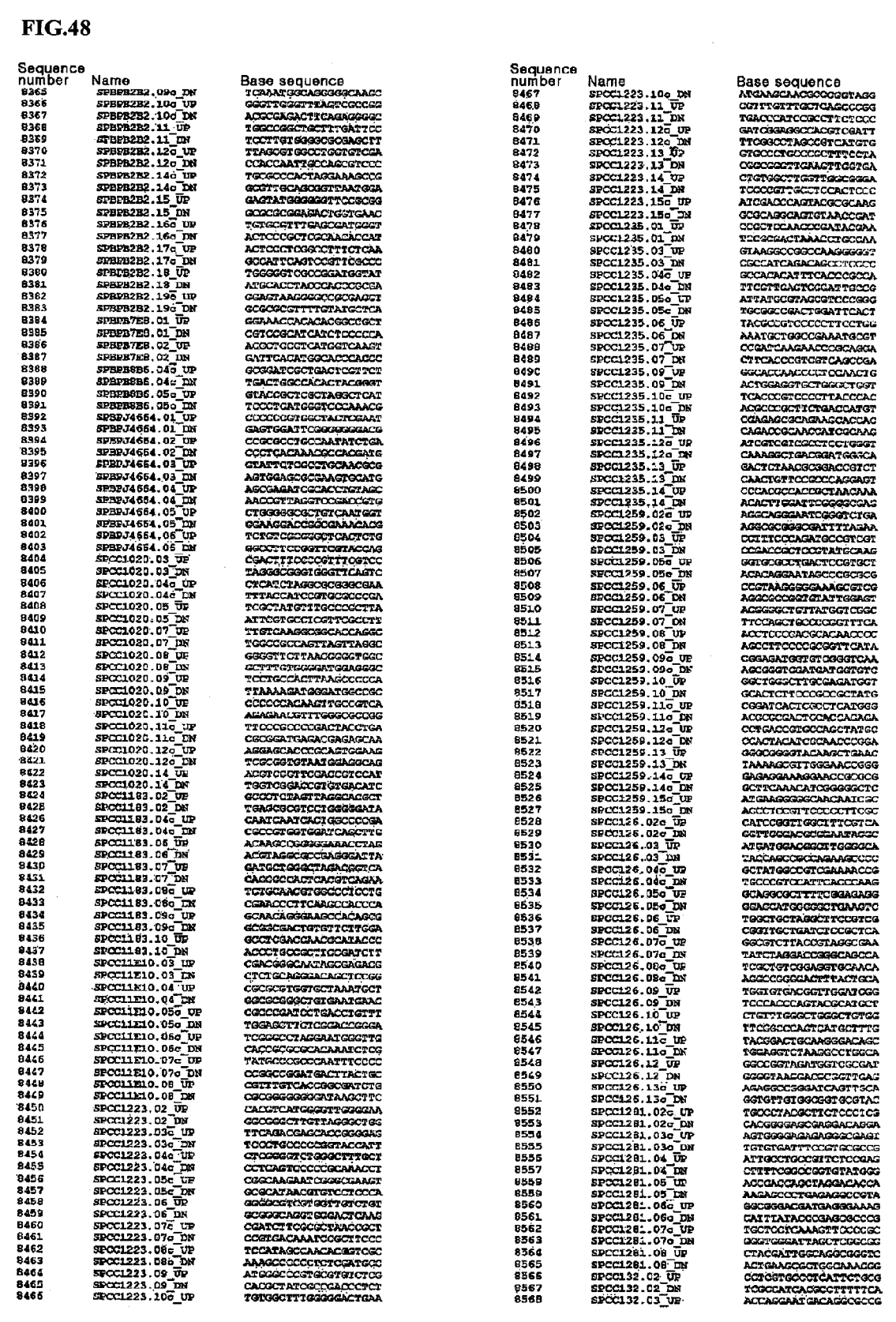

| Sequence number | Name | Base sequence |
|---|---|---|
| 8365 | SPBPB2B2.09c_DN | TCAAATGGCAGGGGGCAAGC |
| 8366 | SPBPB2B2.10c_UP | GGGTTGGGTTAAGTCGCCGG |
| 8367 | SPBPB2B2.10c_DN | ACGCGAGACTTCAGAGGGGC |
| 8368 | SPBPB2B2.11_UP | TGGCCGGCTGCTTTGATTCC |
| 8369 | SPBPB2B2.11_DN | TCCTTGTGGGGCGGGAGCTT |
| 8370 | SPBPB2B2.12c_UP | TTAGCGTGGCCTGGTGTCGA |
| 8371 | SPBPB2B2.12c_DN | CCACCAATTGCCAGCGTCCC |
| 8372 | SPBPB2B2.14c_UP | TGCGCCCACTAGGAAAGCCG |
| 8373 | SPBPB2B2.14c_DN | GCGTTGCAGCGGTTAATGGA |
| 8374 | SPBPB2B2.15_UP | GAGTATGGGGGTTCCGCGG |
| 8375 | SPBPB2B2.15_DN | GCGCGCGGAGACTGGTGAAC |
| 8376 | SPBPB2B2.16c_UP | TGTGCGTTTGAGCGATGGGT |
| 8377 | SPBPB2B2.16c_DN | ACTCCCGCTCGCAACACCAT |
| 8378 | SPBPB2B2.17c_UP | ACTCCCTCGGCCTTTCTCAA |
| 8379 | SPBPB2B2.17c_DN | GCCATTCAGTCCGTTCGCCC |
| 8380 | SPBPB2B2.18_UP | TGGGGGTCGCCGGATGGTAT |
| 8381 | SPBPB2B2.18_DN | ATGCACCTACCCACCCGCGA |
| 8382 | SPBPB2B2.19c_UP | GGAGTAAGGGGCCGCGAGCT |
| 8383 | SPBPB2B2.19c_DN | GCGCGCGTTTTGTATGCTCA |
| 8384 | SPBPB7E8.01_UP | GGAAACCACACACGGCCGCT |
| 8385 | SPBPB7E8.01_DN | CGTCCGCATCATCTCCCCCA |
| 8386 | SPBPB7E8.02_UP | ACGCTGCCTCATGGTCAAGT |
| 8387 | SPBPB7E8.02_DN | GATTCACATGGCACCCACCC |
| 8388 | SPBPB8B6.04c_UP | GCGGATCGCTGACTCGTTCT |
| 8389 | SPBPB8B6.04c_DN | TGACTGGCCACACTACGGGT |
| 8390 | SPBPB8B6.05c_UP | GTACCGCTCGCTAGGCTCAT |
| 8391 | SPBPB8B6.05c_DN | TCCCTGATGGGTCCCAAACG |
| 8392 | SPBPJ4664.01_UP | CCCCCCGTGGCTACTCGAAT |
| 8393 | SPBPJ4664.01_DN | GAGTGGATTCGGGGGGGACG |
| 8394 | SPBPJ4664.02_UP | CCGCGCCTGCCAATATCTGA |
| 8395 | SPBPJ4664.02_DN | CCCTCACAAACGCCACGATG |
| 8396 | SPBPJ4664.03_UP | GTATTCTCGCCTGCAACGCG |
| 8397 | SPBPJ4664.03_DN | AGTGGAGCGCGAAGTGCATG |
| 8398 | SPBPJ4664.04_UP | AGCGAGATCGCACCTGTAGC |
| 8399 | SPBPJ4664.04_DN | AACCGTTAGGTCCGACCGTG |
| 8400 | SPBPJ4664.05_UP | CTGGGGGCGCTGTCAATGGT |
| 8401 | SPBPJ4664.05_DN | GGAAGGACCGGCGAAACACG |
| 8402 | SPBPJ4664.06_UP | TCTGTCGGGGGTCACTCTG |
| 8403 | SPBPJ4664.06_DN | GGCCTTCCGGTTCGTACCAG |
| 8404 | SPCC1020.03_UP | CGACTTTCCCCGTTTCGTCC |
| 8405 | SPCC1020.03_DN | TAGGGCGGGTGGGTTCAGTC |
| 8406 | SPCC1020.04c_UP | CTCATCTAGGCGCGGGCGAA |
| 8407 | SPCC1020.04c_DN | TTTACCATCCGTGCGCCCGA |
| 8408 | SPCC1020.05_UP | TCGCTATGTTTGCCCCCTTA |
| 8409 | SPCC1020.05_DN | ATTCGTGCCTCGTTCGCCTT |
| 8410 | SPCC1020.07_UP | TTGTCAAGGCGGCACCAGGC |
| 8411 | SPCC1020.07_DN | TGGCCGCCAGTTAGTTAGGC |
| 8412 | SPCC1020.08_UP | GGGGTTCTTAACGGGGTGGC |
| 8413 | SPCC1020.08_DN | GCTTTGTGGGGATGGAGGGC |
| 8414 | SPCC1020.09_UP | TCCTGCCACTTAAGCCCCCA |
| 8415 | SPCC1020.09_DN | TTAAAAGATGGGATGGCCGC |
| 8416 | SPCC1020.10_UP | CCCCCCACAAGTTGCCGTCA |
| 8417 | SPCC1020.10_DN | AGAGAAUGTTTGGGCGCCGG |
| 8418 | SPCC1020.11c_UP | TTCCCGCCCCGACTACCTGA |
| 8419 | SPCC1020.11c_DN | CGCGGATGAGACGAGAGCAA |
| 8420 | SPCC1020.12c_UP | AGGAGCACCCGCAGTGGAAG |
| 8421 | SPCC1020.12c_DN | TCGCGGTGTAATGGAGGCAG |
| 8422 | SPCC1020.14_UP | ACGTCGGTTCGACCGTCCAT |
| 8423 | SPCC1020.14_DN | TGGTCGGACCGTGTGACATC |
| 8424 | SPCC1183.02_UP | GCCCTCTAGTTAGGCACGCT |
| 8425 | SPCC1183.02_DN | TGAGCGCGTCCTGGGGGATA |
| 8426 | SPCC1183.04c_UP | CAATCAATCACTGGCCCCGA |
| 8427 | SPCC1183.04c_DN | CGCCGTGGTGGATCAGCTTC |
| 8428 | SPCC1183.06_UP | ACAAGCCGGGGGAAACCTAG |
| 8429 | SPCC1183.06_DN | ACGTAGGCGCCGAGGGATTA |
| 8430 | SPCC1183.07_UP | GATGCTGGGCTAGACGGTCA |
| 8431 | SPCC1183.07_DN | CAGGGCCACTCACGTCAGAA |
| 8432 | SPCC1183.08c_UP | TGTGCAACGTGGCCCTCCTG |
| 8433 | SPCC1183.08c_DN | CGAACCCTTCAAGCCACCCA |
| 8434 | SPCC1183.09c_UP | GCAACAGGGAAGCCACAGCG |
| 8435 | SPCC1183.09c_DN | GCGGCGACTGTGTTCTTGGA |
| 8436 | SPCC1183.10_UP | GCCTCGACCAACGCATACCC |
| 8437 | SPCC1183.10_DN | ACCCTGCCGCTTCCGATCTT |
| 8438 | SPCC11E10.03_UP | CGACGGGCAATAGCGAGACG |
| 8439 | SPCC11E10.03_DN | CTCTGCAGGGACAGCTCCGG |
| 8440 | SPCC11E10.04_UP | CGCGCGTGGTGCTAAATGCT |
| 8441 | SPCC11E10.04_DN | GGCGCGGGCTGTGAATGAAC |
| 8442 | SPCC11E10.05c_UP | CGCCCGATCCTGACCTGTTT |
| 8443 | SPCC11E10.05c_DN | TGGAGCTTGTCGGACCGGGA |
| 8444 | SPCC11E10.06c_UP | TCGGCCCTAGGAATGGGTTG |
| 8445 | SPCC11E10.06c_DN | CACCGCGCGCACAAATCTCG |
| 8446 | SPCC11E10.07c_UP | TATGCCCGGCCAATTTCCCC |
| 8447 | SPCC11E10.07c_DN | CCGGCCGGATGACTTACTGC |
| 8448 | SPCC11E10.08_UP | CGTTTGTCACCGGCGATCTG |
| 8449 | SPCC11E10.08_DN | CGCGGGGGGGATAAGCTTC |
| 8450 | SPCC1223.02_UP | CACGTCATGGGGTTGGGGAA |
| 8451 | SPCC1223.02_DN | GGCGGGCTTGTTAGGGCTGG |
| 8452 | SPCC1223.03c_UP | TTCAGACGAGCACCGGGGAG |
| 8453 | SPCC1223.03c_DN | TCCCTGCCCCCGGTACCATT |
| 8454 | SPCC1223.04c_UP | CTCGGGGTCTGGGCTTTGCT |
| 8455 | SPCC1223.04c_DN | CCTCAGTCCCCCGCAAACCT |
| 8456 | SPCC1223.05c_UP | CGGCAAGAATCGGGCGAAGT |
| 8457 | SPCC1223.05c_DN | GCGCATAACGTGTCCTCCCA |
| 8458 | SPCC1223.06_UP | GGGGCGTCGTGGTTGTCTGT |
| 8459 | SPCC1223.06_DN | GCGGGCAGGTGGGACTCAAG |
| 8460 | SPCC1223.07c_UP | CGATCTTCGCGCTAACCGCT |
| 8461 | SPCC1223.07c_DN | CCGTGACAAATCCGCTTCCC |
| 8462 | SPCC1223.08c_UP | TCCATAGCCAACACGGTCGC |
| 8463 | SPCC1223.08c_DN | AAAGCCCCCCTCTCGATGCC |
| 8464 | SPCC1223.09_UP | ATGGGCCCGTGCGTGTCTCG |
| 8465 | SPCC1223.09_DN | CACGCTATCGCCGACCCTCT |
| 8466 | SPCC1223.10c_UP | TGTGGCTTTGGGGGACTGAA |

| Sequence number | Name | Base sequence |
|---|---|---|
| 8467 | SPCC1223.10c_DN | ATGAAGCAACGCCCGGTAGG |
| 8468 | SPCC1223.11_UP | CGTTTGTTTGCTCAGCCCGG |
| 8469 | SPCC1223.11_DN | TGACCCATCCGCCTTCTCCC |
| 8470 | SPCC1223.12c_UP | GATCGGAGGCCACGTCGATT |
| 8471 | SPCC1223.12c_DN | TTCGGCCTAGCCGTCATGTG |
| 8472 | SPCC1223.13_UP | GTGCCCTGCCCGCTTTCCTA |
| 8473 | SPCC1223.13_DN | CGGCGGGTTGAAGTTGGTGA |
| 8474 | SPCC1223.14_UP | CTGTGGCTTGGTTGGCGGGA |
| 8475 | SPCC1223.14_DN | TCCCCGTTGCCTCCACTCCC |
| 8476 | SPCC1223.15c_UP | ATCGACCCAGTACGCGCAAG |
| 8477 | SPCC1223.15c_DN | GCGCAGGCAGTGTAACCGAT |
| 8478 | SPCC1235.01_UP | CCGCTCCAACCCGATACGAA |
| 8479 | SPCC1235.01_DN | TCCGCGACTAAACCTGCCAA |
| 8480 | SPCC1235.03_UP | GTAAGGCCGGCCAAGGGGGT |
| 8481 | SPCC1235.03_DN | CGCCATCAGACAGCCCTCCCC |
| 8482 | SPCC1235.04c_UP | GCCACACATTTCACCCGCCA |
| 8483 | SPCC1235.04c_DN | TTCGTTGACTCGCATTGCCG |
| 8484 | SPCC1235.05c_UP | ATTATGCGTAGCGTCCCGGG |
| 8485 | SPCC1235.05c_DN | TGCGGCCGACTGGATTCACT |
| 8486 | SPCC1235.06_UP | TACGCCGTCCCCCTTCCTGG |
| 8487 | SPCC1235.06_DN | AAATGCTGGCCGAAATGCGT |
| 8488 | SPCC1235.07_UP | CCGATCAAGAACCCGCAGGA |
| 8489 | SPCC1235.07_DN | CTTCACCCGTCGTCAGCCGA |
| 8490 | SPCC1235.09_UP | GGCACCAACCCCTCCAACTG |
| 8491 | SPCC1235.09_DN | ACTGGAGGTGCTGGGCTGGT |
| 8492 | SPCC1235.10c_UP | TCACCCGTCCCCTTACCCAC |
| 8493 | SPCC1235.10c_DN | ACGCCCGCTTCTGACCATGT |
| 8494 | SPCC1235.11_UP | CGAGAGCGCAGAAGCACCAC |
| 8495 | SPCC1235.11_DN | CAGACCGCAACCATCGCAAG |
| 8496 | SPCC1235.12c_UP | ATCGTCGTCGCCTCCTGGGT |
| 8497 | SPCC1235.12c_DN | CAAAGGCTGACGGATGGGCA |
| 8498 | SPCC1235.13_UP | GACTCTAACGCGGACCGTCT |
| 8499 | SPCC1235.13_DN | CAACTGTTCCGCCCAGGAGT |
| 8500 | SPCC1235.14_UP | CCCACGCCACCGCTAACAAA |
| 8501 | SPCC1235.14_DN | ACACTTGGATTCGGGGCGAG |
| 8502 | SPCC1259.02c_UP | AGGCAGGGAATCGGGTCTGA |
| 8503 | SPCC1259.02c_DN | AGGCGCGGGCGATTTTAGAA |
| 8504 | SPCC1259.03_UP | CGTTTCCCAGATGCCGTCGT |
| 8505 | SPCC1259.03_DN | CCGACCGCTCCGTATGCAAG |
| 8506 | SPCC1259.05c_UP | GGTGCGCCTGACTCCGTGCT |
| 8507 | SPCC1259.05c_DN | ACACAGGAATAGCCCGCGCG |
| 8508 | SPCC1259.06_UP | CCGTAAGGGGAAAGCGTCG |
| 8509 | SPCC1259.06_DN | AGGCGCCGGTGTATTGGAGT |
| 8510 | SPCC1259.07_UP | ACGGGGCTGTTATGGTCGGC |
| 8511 | SPCC1259.07_DN | TTCCAGCTGCCCCGGTTTCA |
| 8512 | SPCC1259.08_UP | ACCTCCCCACGCACAACCCC |
| 8513 | SPCC1259.08_DN | AGCCTTCCCCGCGGTTCATA |
| 8514 | SPCC1259.09c_UP | CGGAGATGGTGTCGGGTCAA |
| 8515 | SPCC1259.09c_DN | AGCGGGTCGATGATGGTGTC |
| 8516 | SPCC1259.10_UP | GGCTGGGCTTGCGAGATGGT |
| 8517 | SPCC1259.10_DN | GCACTCTTCCCGCCGCTATG |
| 8518 | SPCC1259.11c_UP | CGGATCACTCGCCTCATGGG |
| 8519 | SPCC1259.11c_DN | ACGCGCGACTGCACCAGAGA |
| 8520 | SPCC1259.12c_UP | CCTGACCGTGCCAGCTATGC |
| 8521 | SPCC1259.12c_DN | CCACTACATCGCAACCCGGA |
| 8522 | SPCC1259.13_UP | GGGCGGGGTACAAGCTGAAC |
| 8523 | SPCC1259.13_DN | TAAAAGCGTTGGGAACCGGG |
| 8524 | SPCC1259.14c_UP | GAGAGGAAAGGAACCGCGCG |
| 8525 | SPCC1259.14c_DN | GCTTCAAACATCGGGGGCTC |
| 8526 | SPCC1259.15c_UP | ATGAAGGGGGCAACAATCGC |
| 8527 | SPCC1259.15c_DN | AGCCTCCGTTCCCCCTTCGC |
| 8528 | SPCC126.02c_UP | CATCCGGTTGGCTTTCGTCA |
| 8529 | SPCC126.02c_DN | GGTTGCGACGCCGAATAGGC |
| 8530 | SPCC126.03_UP | ATGATGGACGGCTTGGGGCA |
| 8531 | SPCC126.03_DN | TACCAGCCGCCAGAAGCCCC |
| 8532 | SPCC126.04c_UP | GCTATGGCCGTCGAAAACCG |
| 8533 | SPCC126.04c_DN | TGCCCGTCCATTCACCCAAG |
| 8534 | SPCC126.05c_UP | GCAGGCGCTTTTCGGAGAGG |
| 8535 | SPCC126.05c_DN | GGAGCATGGGGGCTGAAGTC |
| 8536 | SPCC126.06_UP | TGGCTGCTAGGCTTCCGTCG |
| 8537 | SPCC126.06_DN | CGGTTGCTGATCTCCGCTCA |
| 8538 | SPCC126.07c_UP | GGCGTCTTACCGTAGGCGAA |
| 8539 | SPCC126.07c_DN | TATCTAGGACCGGGCAGCCA |
| 8540 | SPCC126.08c_UP | TCGCTGTCGGAGGTGCAACA |
| 8541 | SPCC126.08c_DN | AGGCCGGGCACTTTACTGCA |
| 8542 | SPCC126.09_UP | TGGTGTGACGGTTGGATCGG |
| 8543 | SPCC126.09_DN | TCCCACCCAGTACGCATGCT |
| 8544 | SPCC126.10_UP | CTGTTTGGGCTGGGCTGTGG |
| 8545 | SPCC126.10_DN | TTCGGCCCAGTCATGCTTTG |
| 8546 | SPCC126.11c_UP | TACGGACTGCAAGGGACAGC |
| 8547 | SPCC126.11c_DN | TGGAGGTCTAAGGCCTGGCA |
| 8548 | SPCC126.12_UP | GGCCGGTAGATGGTCGCGAT |
| 8549 | SPCC126.12_DN | GGGGTAACGACCCGCTTGAG |
| 8550 | SPCC126.13c_UP | AGAGGCCGGGATCAGTTGCA |
| 8551 | SPCC126.13c_DN | GGTGTTGTGGCGGTGCGTAC |
| 8552 | SPCC1281.02c_UP | TGCCCTACGCTTCTCCCTCG |
| 8553 | SPCC1281.02c_DN | CACGGGGAGCGAGGACAGGA |
| 8554 | SPCC1281.03c_UP | AGTGGGGAGAGAGGGCGAGT |
| 8555 | SPCC1281.03c_DN | TGTGTGATTTCCGTGCGCCG |
| 8556 | SPCC1281.04_UP | ATTGCCTGCCGTTCTCCGAG |
| 8557 | SPCC1281.04_DN | CTTTTCGGCCGGTGTATGGG |
| 8558 | SPCC1281.05_UP | ACCGACCAGCTAGGACACCA |
| 8559 | SPCC1281.05_DN | AAGAGCCCTGAGAGGCCGTA |
| 8560 | SPCC1281.06c_UP | GGCGGGACGATGAGGGAAAG |
| 8561 | SPCC1281.06c_DN | CATTTATACCCGAGCGCCCG |
| 8562 | SPCC1281.07c_UP | TGCTCCTCAAAGTTCCCCGC |
| 8563 | SPCC1281.07c_DN | GGGTGGGATTAGCTCGGCGG |
| 8564 | SPCC1281.08_UP | CTACGATTGGCAGGCGGGTC |
| 8565 | SPCC1281.08_DN | ACTGAAGCGCTGGCAAACGG |
| 8566 | SPCC132.02_UP | CCTCGTGCCCTCATTCTGCG |
| 8567 | SPCC132.02_DN | TCGCCATCACGCCTTTTTCA |
| 8568 | SPCC132.03_UP | ACCAGGAATGACAGGCGCCG |

| Sequence number | Name | Base sequence |
|---|---|---|
| 8773 | SPCC16A11.04_DN | GGCAACTTCCCGTAGGACGA |
| 8774 | SPCC16A11.06c_UP | CGCGCACGGGTAAGCAACCG |
| 8775 | SPCC16A11.06c_DN | CAGAAAGCACAGGGGACGG |
| 8776 | SPCC16A11.07_UP | CGGCCTCGGTTTGGTGGTGT |
| 8777 | SPCC16A11.07_DN | GCGGTAATAAGGCGGGGGT |
| 8778 | SPCC16A11.08_UP | ATAGGCTCGGGGGTCGATGA |
| 8779 | SPCC16A11.08_DN | GTGGTCCAAGCGGTCGATCA |
| 8780 | SPCC16A11.10c_UP | GAAATCCTCACGGGGTGCCTG |
| 8781 | SPCC16A11.10c_DN | GGGGAAAGGTGTCGCATGCG |
| 8782 | SPCC16A11.11_UP | GCGCTCGTTAATGCTCACGA |
| 8783 | SPCC16A11.11_DN | ADGCAGAGAGGGCGCAGAAGC |
| 8784 | SPCC16A11.12c_UP | TGCTCGTATTGCCTTGGTCC |
| 8785 | SPCC16A11.12c_DN | GGCGTGGGCAGAGAGAGGTG |
| 8786 | SPCC16A11.14_UP | CCAAAAGGGCATGGTCCACG |
| 8787 | SPCC16A11.14_DN | CGGGACGGAGAGGGCTGACT |
| 8788 | SPCC16A11.15c_UP | TGAGCCTCCGAGTGGTGTGT |
| 8789 | SPCC16A11.15c_DN | ACGTGACTCTAGCGCAGCGA |
| 8790 | SPCC16A11.16c_UP | CATTACCTAGCGACGCCTTC |
| 8791 | SPCC16A11.16c_DN | ACATAGTGCAGGTCCGTCGC |
| 8792 | SPCC16C4.01_UP | CTCCACCTCCCGCCTTCTCC |
| 8793 | SPCC16C4.01_DN | GGACGTCACCTGACCGTCTT |
| 8794 | SPCC16C4.02c_UP | AGTTGTAGGGTCGGGGGGAG |
| 8795 | SPCC16C4.02c_DN | ATGAGGGGTTGGCGGTGGG |
| 8796 | SPCC16C4.03_UP | CCCCGGCTCTCGTCTTCTCC |
| 8797 | SPCC16C4.03_DN | GGCCGCACCAACATCTTCCG |
| 8798 | SPCC16C4.05_UP | CGCCGTATTTCCCCAGTTCG |
| 8799 | SPCC16C4.05_DN | CGTCCGGGCTGACGTAACTT |
| 8800 | SPCC16C4.06c_UP | GAGTCGGCGGGCTTTCAGGT |
| 8801 | SPCC16C4.06c_DN | AGGTGTGGGTGTTCTGGCGC |
| 8802 | SPCC16C4.07_UP | CGCCCCCTCGTCAACACCCT |
| 8803 | SPCC16C4.07_DN | CTCCCCTGTTCTCGCCCACC |
| 8804 | SPCC16C4.08c_UP | GGAAGTGGGCCGTAAAGCGA |
| 8805 | SPCC16C4.08c_DN | GCTTGTGCAAGCCGATACGC |
| 8806 | SPCC16C4.09_UP | ATCACGCCCTCCCACTTCGT |
| 8807 | SPCC16C4.09_DN | TTTGCGTGGTTCGCTGCGTA |
| 8808 | SPCC16C4.10_UP | TCAAGTCGCCTTAGACCCGT |
| 8809 | SPCC16C4.10_DN | AGCCTATGCCCGCTTCACCG |
| 8810 | SPCC16C4.11_UP | CCAGACCGCGAGCCGAAGAA |
| 8811 | SPCC16C4.11_DN | TGGATCCCGTGGGCCGTATT |
| 8812 | SPCC16C4.12_UP | GGCCGGATTAGTGCCACCTA |
| 8813 | SPCC16C4.12_DN | CGGTGTACGTCGAACCGTTG |
| 8814 | SPCC16C4.13c_UP | ACGGTACTCGCGAGAGTGGA |
| 8815 | SPCC16C4.13c_DN | TGCCGTGACTTTATGCTGGT |
| 8816 | SPCC16C4.14c_UP | AACTGGCCCACTACCCGTCG |
| 8817 | SPCC16C4.14c_DN | GCTGACCTAAAGACGGCGGG |
| 8818 | SPCC16C4.15_UP | GACGTTAAATGGCGAGCGCG |
| 8819 | SPCC16C4.15_DN | GCGCGGGGTTATCGTGCTT |
| 8820 | SPCC16C4.16c_UP | ATAGGCCCGGAACTCGCACT |
| 8821 | SPCC16C4.16c_DN | TCATCGGGAACTCCACTGCG |
| 8822 | SPCC16C4.17_UP | TGGAGCCCGGACAGGACTAA |
| 8823 | SPCC16C4.17_DN | ACTACACGGACCACGGGAAA |
| 8824 | SPCC16C4.18c_UP | TTGCCCCTCATTCCCCGCCA |
| 8825 | SPCC16C4.18c_DN | CCAGCGGCGTTGCGTTTCAGA |
| 8826 | SPCC16C4.20c_UP | GAGCACGGGGTATCCAATGC |
| 8827 | SPCC16C4.20c_DN | TCGTTGCGCCCTTGTTCACC |
| 8828 | SPCC1739.02c_UP | GGTCATGGTAGGGTGGCGGG |
| 8829 | SPCC1739.02c_DN | GTTCCACTCTACTCGGCGGC |
| 8830 | SPCC1739.03_UP | GTCTTCTGGAGGTGCGGGGA |
| 8831 | SPCC1739.03_DN | CGAGGAAACGGTGATCGGGT |
| 8832 | SPCC1739.04c_UP | TGAAGCCCGGGTGATACCGA |
| 8833 | SPCC1739.04c_DN | TGCTGCCTGGACGGCTGTTA |
| 8834 | SPCC1739.05_UP | AGAGTGCCGAGCACTGAGAC |
| 8835 | SPCC1739.05_DN | AGTCCCTAGCTACAGGCGGA |
| 8836 | SPCC1739.06c_UP | CCAGCGTGTCGTGCAGAGAT |
| 8837 | SPCC1739.06c_DN | ACTCTGCGATCCGTGAAGC |
| 8838 | SPCC1739.07_UP | GCCAAGGGTGGGCGGAAATC |
| 8839 | SPCC1739.07_DN | GGGGGGGAGTCAATAGGCA |
| 8840 | SPCC1739.08c_UP | ACTTCCGGCACGACCGGATAG |
| 8841 | SPCC1739.08c_DN | ACCCGGTTAGCCTCGCATAC |
| 8842 | SPCC1739.09c_UP | CATCAAGCAGGGCGAGGCCA |
| 8843 | SPCC1739.09c_DN | CCACGTGTCCCAACCAGCCA |
| 8844 | SPCC1739.10_UP | TGGTAGCCTCGTACAGGCGA |
| 8845 | SPCC1739.10_DN | TAGGACAAGGCCGCGGGAC |
| 8846 | SPCC1739.11c_UP | GTGTTGAGGGAAGCGAGGCG |
| 8847 | SPCC1739.11c_DN | ACTGACGGGAGGGCATACGG |
| 8848 | SPCC1739.12_UP | CCGGCAAGAAAATGTGCCCT |
| 8849 | SPCC1739.12_DN | ACCACACCCCGTTGCCTCGT |
| 8850 | SPCC1739.13_UP | AGGACTCCGCTAGTGCCCTT |
| 8851 | SPCC1739.13_DN | AACACAGCTCGGAGCCTCAC |
| 8852 | SPCC1739.14_UP | TGACCTCGTGGGACGACTGT |
| 8853 | SPCC1739.14_DN | CGCTCGACGCTCTGTGACAA |
| 8854 | SPCC1742.01_UP | TGTTAAAGTCGCAACGGTGCT |
| 8855 | SPCC1742.01_DN | AGGTCGGACACCCTCACGTA |
| 8856 | SPCC1753.02c_UP | TTTGGGGCGACTTCGCCATG |
| 8857 | SPCC1753.02c_DN | CCCCCCTGAGAACGCACCAA |
| 8858 | SPCC1753.03c_UP | TGGTTAAGCCGCTCGGGGGT |
| 8859 | SPCC1753.03c_DN | GCGCCCAATGAAAGGGTTTG |
| 8860 | SPCC1753.04_UP | TTGGATGCCGTGTGACGAGA |
| 8861 | SPCC1753.04_DN | AGGGCCACGCCTTAGTACACC |
| 8862 | SPCC1753.05_UP | ATCCACCGGTCCGGGTTAGT |
| 8863 | SPCC1753.05_DN | GGGCGGTATCGTAACTGCGG |
| 8864 | SPCC1795.03_UP | GTCCGGCGGGTAGAGTGGCA |
| 8865 | SPCC1795.03_DN | CGTTGGTGATACCGGAGGGG |
| 8866 | SPCC1795.04c_UP | TGGCTTGCCACGGGGATCTT |
| 8867 | SPCC1795.04c_DN | TTTCGGGCGTAAGTGCCCC |
| 8868 | SPCC1795.05c_UP | TAATACCTTTCGCCGCCCCA |
| 8869 | SPCC1795.05c_DN | GCATGCTGTCGGTGGCCT |
| 8870 | SPCC1795.06_UP | CTGCTGCGGATGGGGTTCTG |
| 8871 | SPCC1795.06_DN | TGGCGATGGCTTTGCAGGTA |
| 8872 | SPCC1795.07_UP | AGTGGGCAGTTGCCGCATCAT |
| 8873 | SPCC1795.07_DN | AAGCCTCAAGCCCAACGCAC |
| 8874 | SPCC1795.09_UP | AATCCGTGTCCCCCCACGAC |
| 8875 | SPCC1795.09_DN | ATGGACGGGTTTGAGGGGGC |
| 8876 | SPCC1795.10c_UP | GACAAGTCGCACTTGCACCC |
| 8877 | SPCC1795.10c_DN | ATCTGCGACCCTACGGAACC |
| 8878 | SPCC1795.11_UP | TGGGTGCCCAGTACGGTCGT |
| 8879 | SPCC1795.11_DN | TGGAGGTCGACGGAAACTCG |
| 8880 | SPCC1795.12c_UP | GTGGCACCGACCGGTTACAA |
| 8881 | SPCC1795.12c_DN | TAACGGATGAGATCCGCCCG |
| 8882 | SPCC18.02_UP | CGCCGTAAACCCCCACTTTC |
| 8883 | SPCC18.02_DN | AGCAACCCCTGCCCACAGA |
| 8884 | SPCC18.03_UP | AGGGCGACGGGTAGGATGGT |
| 8885 | SPCC18.03_DN | GGGGATTCGGTGTCGTTGGA |
| 8886 | SPCC18.05c_UP | AGTGTGCATGGGCACTGTCT |
| 8887 | SPCC18.05c_DN | AACCCTCTTCGCGTCCGGCT |
| 8888 | SPCC18.06c_UP | ACCAAAAGCCCCTAGCGCC |
| 8889 | SPCC18.06c_DN | AGTCGCGACACGCGACTCT |
| 8890 | SPCC18.07_UP | TGTCAAAACCGGGTCAACCT |
| 8891 | SPCC18.07_DN | GCAATCCGCCCGACCACTAT |
| 8892 | SPCC18.08_UP | CTACGCGGGCATTTGCACGA |
| 8893 | SPCC18.08_DN | GCAACTTCGGGAAAGCGGAC |
| 8894 | SPCC18.09c_UP | TGAGAGCGCACGGTGCATTA |
| 8895 | SPCC18.09c_DN | CGCCGTGGGTGATCCGAAAG |
| 8896 | SPCC18.10_UP | GCCGGCAGCAGAAAAGGTAGG |
| 8897 | SPCC18.10_DN | TGGACGTGCGCCGGAAGTTG |
| 8898 | SPCC18.11c_UP | AGTGCACCCTACGGCGATTC |
| 8899 | SPCC18.11c_DN | TGTCACAGGGACCCAGGCAT |
| 8900 | SPCC18.12c_UP | TTTCTGCCCACTAAGGCCGC |
| 8901 | SPCC18.12c_DN | GTCGGAGCGGATCGCAGTTC |
| 8902 | SPCC18.14c_UP | AGTAGCCCCTGACTTGACGC |
| 8903 | SPCC18.14c_DN | GACACAGTCGGCTCCGCAAT |
| 8904 | SPCC18.16c_UP | CGCGGGCCGTTAACCGAGATC |
| 8905 | SPCC18.16c_DN | ACTTGCCCGTTCCACCCAGC |
| 8906 | SPCC18.17c_UP | GTCCCTAAGAAACCCCGCGA |
| 8907 | SPCC18.17c_DN | CGATAGGGCAACGGGGGATG |
| 8908 | SPCC1827.02c_UP | AGGGAGGTGGCGCTTAGGGA |
| 8909 | SPCC1827.02c_DN | CAAACGTGGGTGCAGGCTCG |
| 8910 | SPCC1827.03c_UP | CAACGGCACAGCAAACCCCA |
| 8911 | SPCC1827.03c_DN | TGCCTGTCCCTCGCCTGATT |
| 8912 | SPCC1827.04_UP | TGTGGATGGCGCAGTTGAGGT |
| 8913 | SPCC1827.04_DN | CCGCGTTCTCGCTGCTTGTC |
| 8914 | SPCC1827.05c_UP | AAGGGCCAACGTCGCACACT |
| 8915 | SPCC1827.05c_DN | CGAGGTCACGTTAAGCCCCT |
| 8916 | SPCC1827.08c_UP | GGAGCAAGATCGGGTACGGT |
| 8917 | SPCC1827.08c_DN | GCTGATCTCACGCGACTCCA |
| 8918 | SPCC1840.02c_UP | GTACAACTGCCGGCCTGCCA |
| 8919 | SPCC1840.02c_DN | GCCGGTAAAGCCATCGCCAC |
| 8920 | SPCC1840.04_UP | GGGGGGCGAGTGAGGTGTTG |
| 8921 | SPCC1840.04_DN | TTCCAAGCTACTCGCGCCCC |
| 8922 | SPCC1840.05c_UP | GTAGCGGCCCTTTTCGGTGA |
| 8923 | SPCC1840.05c_DN | CTGGCGGGTGTTGGTGGAC |
| 8924 | SPCC1840.06_UP | CGTTTCGCCGTTTTCAGCAG |
| 8925 | SPCC1840.06_DN | GGCGATTTCCTTTCCTTGCG |
| 8926 | SPCC1840.07c_UP | AAACTTTTCGGAACGCCGGG |
| 8927 | SPCC1840.07c_DN | CTTTATGGGGCCGGGGTTGC |
| 8928 | SPCC1840.08c_UP | TTAAACCCTCGCGCACACCA |
| 8929 | SPCC1840.08c_DN | CGTCGCTACTTGTTCCCCCC |
| 8930 | SPCC1840.09_UP | TCATCGGGGAAGCACAGGC |
| 8931 | SPCC1840.09_DN | ACGTCGCGGTTATATCGGGC |
| 8932 | SPCC1840.10_UP | GGCTCTTTGCGGTTGTCGC |
| 8933 | SPCC1840.10_DN | TTCCCCACCCCAACCCGAAT |
| 8934 | SPCC188.02_UP | AACCCCGTTCGCAGACGATC |
| 8935 | SPCC188.02_DN | GGAGCGGTGTCAACAGGGGA |
| 8936 | SPCC188.03_UP | GGCCCCTTGCGTGTTAGTG |
| 8937 | SPCC188.03_DN | CTCAATGCAATGCGGCGTGCC |
| 8938 | SPCC188.06c_UP | CTGCGTGGCAGTCCCAAATG |
| 8939 | SPCC188.06c_DN | AGATCTACGCGGTGACGCGA |
| 8940 | SPCC188.07_UP | CACGAGCCCCGCACATACAA |
| 8941 | SPCC188.07_DN | CAGATCGCGGTTTGCCTTCA |
| 8942 | SPCC188.08c_UP | TAACCCCCGCCACCAAGACA |
| 8943 | SPCC188.08c_DN | ACACACGAACCCGCACAACC |
| 8944 | SPCC188.09c_UP | AACCTTTCTGTGACGGCGGG |
| 8945 | SPCC188.09c_DN | ACCGGATACGGCTTCCCTCA |
| 8946 | SPCC18B5.04_UP | ATCCAAGGGTCTCAATCCGA |
| 8947 | SPCC18B5.04_DN | TCACCCTTCTTTGGCTCGCA |
| 8948 | SPCC18B5.05c_UP | CTACGGCCCGTTGGATTGGG |
| 8949 | SPCC18B5.05c_DN | CCGGCAAACCCCACGACAAC |
| 8950 | SPCC18B5.06_UP | CGCGTCTCATCGATGCCCTT |
| 8951 | SPCC18B5.06_DN | CGGATCAGGGGCGAGGGTTT |
| 8952 | SPCC18B5.07c_UP | CGAGACGCACCCAACATCCC |
| 8953 | SPCC18B5.07c_DN | TCTTTGATGGGGGCAAGCG |
| 8954 | SPCC18B5.08c_UP | CAGACCTGTTGAACGCCCCA |
| 8955 | SPCC18B5.08c_DN | GGGCCATCTCGAACTTGCAC |
| 8956 | SPCC18B5.09c_UP | TCTGTTAAGGGCGGCATGGG |
| 8957 | SPCC18B5.09c_DN | GGAAAGAGAGCGGCACGGGT |
| 8958 | SPCC18B5.10c_UP | AACGGGCGGGATGAGGTGGT |
| 8959 | SPCC18B5.10c_DN | CTTCATTCCCCCTTCCCGCG |
| 8960 | SPCC18B5.11c_UP | TTCAATACGGCGGGACACGA |
| 8961 | SPCC18B5.11c_DN | CGGGCAAGGTACCCCCAACT |
| 8962 | SPCC1902.02_UP | ACAAGCCGCCAGAGCCTCAA |
| 8963 | SPCC1902.02_DN | AATGGAAGGTGCCTGCGTGA |
| 8964 | SPCC1906.01_UP | CTCACAGTTCGGGGTTGTCC |
| 8965 | SPCC1906.01_DN | ACCGGCCAATTCCTTCCTCC |
| 8966 | SPCC1906.02c_UP | GCGGGTGGGTTAGTGTGCGG |
| 8967 | SPCC1906.02c_DN | AGCCCCGGCCACCCAGTCTA |
| 8968 | SPCC1906.03_UP | CCTTATCGACGTTCCGCCA |
| 8969 | SPCC1906.03_DN | CCCTCGCTCCTGTCGTCGGCT |
| 8970 | SPCC1906.04_UP | TAAGGGCCGGGGATCGTCTC |
| 8971 | SPCC1906.04_DN | TATCCGGCGGGCATTTCTTG |
| 8972 | SPCC191.01_UP | AGCGCAACCCAGCAAAATC |
| 8973 | SPCC191.01_DN | ACTAGGAGCACATGGGCGG |
| 8974 | SPCC191.03c_UP | CGCCGGCGCGCTAGGTTACAA |
| 8975 | SPCC191.03c_DN | CCGATCATAGCACAAGCCGA |
| 8976 | SPCC191.04c_UP | TCCTCGCCTCCACCACCATA |

FIG.51

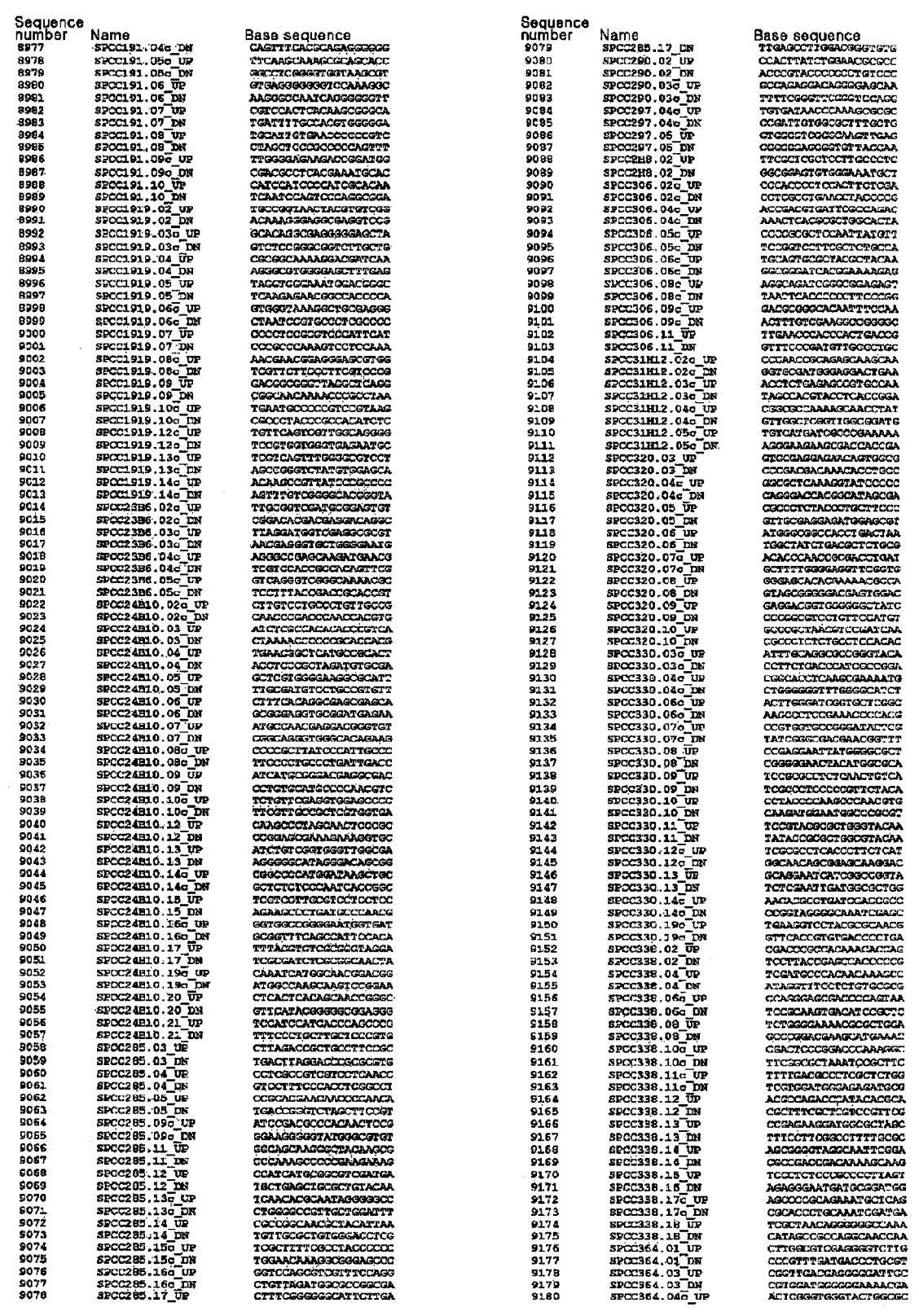

| Sequence number | Name | Base sequence |
|---|---|---|
| 8977 | SPCC191.04c_DN | CAGTTTCACGCAGAGGGGGG |
| 8978 | SPCC191.05c_UP | TTCAAGCAAAGCGCAGCACC |
| 8979 | SPCC191.05c_DN | GGCCTCGGGGTGGTAAGCGT |
| 8980 | SPCC191.06_UP | GTGAGGGGGGGTCCAAAGGC |
| 8981 | SPCC191.06_DN | AAGGGCCAATCAGGGGGGTT |
| 8982 | SPCC191.07_UP | CGTCCACTCACAAGCGGGCA |
| 8983 | SPCC191.07_DN | TGATTTTGCCACGTGGGGGA |
| 8984 | SPCC191.08_UP | TGCATTGTGAACCCCCCGTC |
| 8985 | SPCC191.08_DN | CTAGCTCCCGCCCCCAGTTT |
| 8986 | SPCC191.09c_UP | TTGGGGAGAAGACCGGATGG |
| 8987 | SPCC191.09c_DN | CGACGCCTCACGAAATGCAC |
| 8988 | SPCC191.10_UP | CATCCATCCCCATCGCACAA |
| 8989 | SPCC191.10_DN | TCAATCCAGTCCCAGGCGGA |
| 8990 | SPCC1919.02_UP | TGCCGGTAACTACGTGTCGG |
| 8991 | SPCC1919.02_DN | ACAAAGGGAGGCGAGGTCCG |
| 8992 | SPCC1919.03c_UP | GCACAGGCGAGGGGGAGCTA |
| 8993 | SPCC1919.03c_DN | GTCTCCGGGCGGTCTTGCTG |
| 8994 | SPCC1919.04_UP | CGCGGCAAAAGGACGATCAA |
| 8995 | SPCC1919.04_DN | AGGGCGTGGGGAGCTTTGAG |
| 8996 | SPCC1919.05_UP | TAGGTGGCAAATGGACGGGC |
| 8997 | SPCC1919.05_DN | TCAAGAGAACGGCCACCCCA |
| 8998 | SPCC1919.06c_UP | GTGGGTAAAGGCTGCGAGGG |
| 8999 | SPCC1919.06c_DN | CTAATCCGTGCCCTCGCCCC |
| 9000 | SPCC1919.07_UP | CCCCTCCGCGTCCCATTCAT |
| 9001 | SPCC1919.07_DN | CCCGCCCAAAGTCCTCCAAA |
| 9002 | SPCC1919.08c_UP | AACGAACGGAGGGAGCGTGG |
| 9003 | SPCC1919.08c_DN | TCGTTCTTCCCTTCGTCCCG |
| 9004 | SPCC1919.09_UP | GACGGCGGGTTAGGCTCAGG |
| 9005 | SPCC1919.09_DN | CGGCAACAAAACCCGCCTAA |
| 9006 | SPCC1919.10c_UP | TGAATGCCCCCGTCCGTAAG |
| 9007 | SPCC1919.10c_DN | CGCCCTACCCGCCACATCTC |
| 9008 | SPCC1919.12c_UP | TGTTCAGTCGTTGGCAGGGG |
| 9009 | SPCC1919.12c_DN | TCCGTGGTGGGTGAGAATGC |
| 9010 | SPCC1919.13c_UP | TCGTCAGTTTGGGGCGTCCT |
| 9011 | SPCC1919.13c_DN | AGCCGGGTCTATGTGGAGCA |
| 9012 | SPCC1919.14c_UP | ACAAGCCGTTATCCCGCCCC |
| 9013 | SPCC1919.14c_DN | AGTTTGTCGGGGCACGGGTA |
| 9014 | SPCC23B6.02c_UP | TTGCGGTCGATGCGGAGTGT |
| 9015 | SPCC23B6.02c_DN | CGGACACGACGAGGACAGGC |
| 9016 | SPCC23B6.03c_UP | TTAGGATGGTCGAGGCGCGT |
| 9017 | SPCC23B6.03c_DN | AACGAGGGTGCTGGGGAATG |
| 9018 | SPCC23B6.04c_UP | AGGGCCGAGCAAGATGAACG |
| 9019 | SPCC23B6.04c_DN | TCGTCCACCGCCACAGTTCG |
| 9020 | SPCC23B6.05c_UP | GTCAGGGTCGGGCAAAACGC |
| 9021 | SPCC23B6.05c_DN | TCCTTTACCGACCGCACCGT |
| 9022 | SPCC24B10.02c_UP | CTTGTCCTGCCCTGTTGCCG |
| 9023 | SPCC24B10.02c_DN | CAACCCGACCCAACCACGTG |
| 9024 | SPCC24B10.03_UP | ATCTCGCCACACACCCGTCA |
| 9025 | SPCC24B10.03_DN | CTAAAACCCCCCGCACCACG |
| 9026 | SPCC24B10.04_UP | TGAACGGCTCATGCCGCACT |
| 9027 | SPCC24B10.04_DN | ACCTCCCGCTAGATGTGCGA |
| 9028 | SPCC24B10.05_UP | GCTCGTGGGGAAGGCGCATT |
| 9029 | SPCC24B10.05_DN | TTGCGATGTCCTGCCGTGTT |
| 9030 | SPCC24B10.06_UP | CTTTCACAGGCGAGCGAGCA |
| 9031 | SPCC24B10.06_DN | GCGGGAGGTGCGGATGAGAA |
| 9032 | SPCC24B10.07_UP | ATGCCAACGAGGACGGGTGT |
| 9033 | SPCC24B10.07_DN | CGGCAGGGTGGGCACAGAAG |
| 9034 | SPCC24B10.08c_UP | CCCCGCTTATCCCATTGCCC |
| 9035 | SPCC24B10.08c_DN | TTCCCCTGCCCTGATTGACC |
| 9036 | SPCC24B10.09_UP | ATCATGCGGGACGAGGCGAC |
| 9037 | SPCC24B10.09_DN | CCTGTGCATGCCCCAACGTC |
| 9038 | SPCC24B10.10c_UP | TCTGTTCGAGGTGGAGCCCC |
| 9039 | SPCC24B10.10c_DN | TTCGTTGCCGCTCGTGGTGA |
| 9040 | SPCC24B10.12_UP | CAAGCCCTAGCAACTCCCGC |
| 9041 | SPCC24B10.12_DN | CCGGAGCGAAAGAAAGGTGC |
| 9042 | SPCC24B10.13_UP | ATCTGTCGGTGGGTTGGCGA |
| 9043 | SPCC24B10.13_DN | AGGGGGCATAGGGACAGCGG |
| 9044 | SPCC24B10.14c_UP | CGGCCCCATGGATAAGCTGC |
| 9045 | SPCC24B10.14c_DN | GCTCTCTCCCAATCACCGGC |
| 9046 | SPCC24B10.15_UP | TCGTCGTTGCGTCCTCCTCC |
| 9047 | SPCC24B10.15_DN | AGAAGCCCTGATGCCCAACG |
| 9048 | SPCC24B10.16c_UP | GGTGGCCGGGGAATGGTGAT |
| 9049 | SPCC24B10.16c_DN | GCGGTTTCAGCCATTCCACA |
| 9050 | SPCC24B10.17_UP | TTTACGTCTCGCCGGTAGGA |
| 9051 | SPCC24B10.17_DN | TCGCGATCTCGCGGCAACTA |
| 9052 | SPCC24B10.19c_UP | CAAATCATGGCAACGGACGG |
| 9053 | SPCC24B10.19c_DN | ATGGCCAAGCAAGTCCGGAA |
| 9054 | SPCC24B10.20_UP | CTCACTCACAGCAACCGGGC |
| 9055 | SPCC24B10.20_DN | GTTCATACGGGGGCGGAGGG |
| 9056 | SPCC24B10.21_UP | TCCATCCATCACCCAGCCCG |
| 9057 | SPCC24B10.21_DN | TTTCCCTGCTTGCTCCCGTG |
| 9058 | SPCC285.03_UP | CTTAGACCGCTGCCTTCCGC |
| 9059 | SPCC285.03_DN | TGACTTAGGACCCGCGCGTG |
| 9060 | SPCC285.04_UP | CCTCGCCGTCGTCCTCAACC |
| 9061 | SPCC285.04_DN | GTCCTTTCCCACCTCGGCCT |
| 9062 | SPCC285.05_UP | CCGCACGAACAACCCCAACA |
| 9063 | SPCC285.05_DN | TGACCGGGTCTAGCTTCCGT |
| 9064 | SPCC285.09c_UP | ATCCGACGCCCACAACTCCG |
| 9065 | SPCC285.09c_DN | GGAAGGGGGTATGGGCGTGT |
| 9066 | SPCC285.11_UP | GGCAGCAAGGGCTACAAGCG |
| 9067 | SPCC285.11_DN | GCCAAAGCCCCCGAAGAAAG |
| 9068 | SPCC285.12_UP | CCATCATGCGGCGTCGATGA |
| 9069 | SPCC285.12_DN | TGCTGAGCTGCGCTGTACAA |
| 9070 | SPCC285.13c_UP | TCAACACGCAATAGGGGGCC |
| 9071 | SPCC285.13c_DN | CTGGGGCCGTTGCTGGATTT |
| 9072 | SPCC285.14_UP | CGCCGGCAACGCTACATTAA |
| 9073 | SPCC285.14_DN | TGTTGCGCTGTGGGACCTCG |
| 9074 | SPCC285.15c_UP | TCGCTTTTCGCCTACCCCCC |
| 9075 | SPCC285.15c_DN | TGGAACAAAGGCGGGAGCCC |
| 9076 | SPCC285.16c_UP | GGTCCAGCGTCGTTTCCAGG |
| 9077 | SPCC285.16c_DN | CTGTTAGATGGCGCCGGCGA |
| 9078 | SPCC285.17_UP | CTTTCGGGGGGCATTCTTGA |
| 9079 | SPCC285.17_DN | TTGAGCCTTGGACGGGTGTG |
| 9080 | SPCC290.02_UP | CCACTTATCTGGAACGCGCC |
| 9081 | SPCC290.02_DN | ACCCGTACCCCCCCTGTCCC |
| 9082 | SPCC290.03c_UP | GCCAGAGGACAGGGGAGCAA |
| 9083 | SPCC290.03c_DN | TTTTCGGGTTCGGGTCCAGG |
| 9084 | SPCC297.04c_UP | TGTGATAACCCAAAGCGCGC |
| 9085 | SPCC297.04c_DN | CCGATTGTGGCGCTTTGCTG |
| 9086 | SPCC297.05_UP | GTGGCGTCGGCCAAGTTGAG |
| 9087 | SPCC297.05_DN | CGGCGGAGCGGTGTTACCAA |
| 9088 | SPCC2H8.02_UP | TTCGCTCGCTCCTTGCCCTC |
| 9089 | SPCC2H8.02_DN | GGCGGAGTGTGGGAAATGCT |
| 9090 | SPCC306.02c_UP | CCCACCCCTCCACTTCTCGA |
| 9091 | SPCC306.02c_DN | CCTCGCCTGAACCTACCCCG |
| 9092 | SPCC306.04c_UP | ACCGACGTGATTCGCCAGAC |
| 9093 | SPCC306.04c_DN | AAACTCACGCGCTGGCACTA |
| 9094 | SPCC306.05c_UP | CCCCGCGCTCCAATTATGTT |
| 9095 | SPCC306.05c_DN | TCCGGTCCTTCGCTCTGCCA |
| 9096 | SPCC306.06c_UP | TGCAGTGCGCTACGCTACAA |
| 9097 | SPCC306.06c_DN | GGCGGGATCACGGAAAAGAG |
| 9098 | SPCC306.08c_UP | AGGCAGATCGGGCGGAGAGT |
| 9099 | SPCC306.08c_DN | TAATTCACCCCCCTTCCCGG |
| 9100 | SPCC306.09c_UP | GACGCGGGCACAATTTCCAA |
| 9101 | SPCC306.09c_DN | ACTTTGTCGAAGGCCGGGGC |
| 9102 | SPCC306.11_UP | TTGAACCCACCCACTGACCG |
| 9103 | SPCC306.11_DN | GTTTCCCGATGTTGGCCTGC |
| 9104 | SPCC31H12.02c_UP | CCCAACCGCAGAGCAAGCAA |
| 9105 | SPCC31H12.02c_DN | GGTGCGATGGGAGGACTGAA |
| 9106 | SPCC31H12.03c_UP | ACCTCTGAGAGCCGTGCCAA |
| 9107 | SPCC31H12.03c_DN | TAGCCACGTACCTCACCGGA |
| 9108 | SPCC31H12.04c_UP | CGGCGCCAAAAGCAACCTAT |
| 9109 | SPCC31H12.04c_DN | GTTGGCTCGGTTGGCGGATG |
| 9110 | SPCC31H12.05c_UP | TGTCATGATCGCCCGAAAAA |
| 9111 | SPCC31H12.05c_DN | AGGGAAGAAGCGACCACCGA |
| 9112 | SPCC320.03_UP | GTGCCGAGGAGAACAGTGGCG |
| 9113 | SPCC320.03_DN | CCCGACGACAAACACCTGCC |
| 9114 | SPCC320.04c_UP | GGCGCTCAAAGGTATCCCCC |
| 9115 | SPCC320.04c_DN | CAGGGACCACGGCATAGCGA |
| 9116 | SPCC320.05_UP | CGCCCTCTACCCTGCTTCCC |
| 9117 | SPCC320.05_DN | GTTGCGAGGAGATGGAGCGT |
| 9118 | SPCC320.06_UP | ATGGGCGGCCACCTGACTAA |
| 9119 | SPCC320.06_DN | TGGCTATCTGACGCTCTGCG |
| 9120 | SPCC320.07c_UP | ACACCCAACCGCGACCTGAT |
| 9121 | SPCC320.07c_DN | GCTTTTGGGGAGGTTCGGTG |
| 9122 | SPCC320.08_UP | GGGAGCACACGAAAACGCCA |
| 9123 | SPCC320.08_DN | GTAGCGGGGGACGAGTGGAC |
| 9124 | SPCC320.09_UP | GAGGACGGTGGGGGGCTATC |
| 9125 | SPCC320.09_DN | CCCGGCGTCCTGTTCCATGT |
| 9126 | SPCC320.10_UP | GCCCGCTAACGTCCGATCAA |
| 9127 | SPCC320.10_DN | CGCCCTCTCTGCCTCCACAC |
| 9128 | SPCC330.03c_UP | ATTTGCAGGCGCCGGGTACA |
| 9129 | SPCC330.03c_DN | CCTTCTGACCCATCGCCGGA |
| 9130 | SPCC330.04c_UP | CGGCACCTCAAGCGAAAATG |
| 9131 | SPCC330.04c_DN | CTGGGGGGTTTGGGGCATCT |
| 9132 | SPCC330.06c_UP | ACTTGGGATCGGTGCTCGGC |
| 9133 | SPCC330.06c_DN | AAGCCCTCCGAAACCCCACG |
| 9134 | SPCC330.07c_UP | CCGTGGTGCCGGGATACTCG |
| 9135 | SPCC330.07c_DN | TATCGGGCGACGAACGGTTT |
| 9136 | SPCC330.08_UP | CCGAGGAATTATGGGGCGCT |
| 9137 | SPCC330.08_DN | CGGGGGAACTACATGGCGCA |
| 9138 | SPCC330.09_UP | TCCGCGCCTCTCAACTGTCA |
| 9139 | SPCC330.09_DN | TCGCCCTCCCCCGTTCTACA |
| 9140 | SPCC330.10_UP | CCTACCCCAAGCCCAACGTG |
| 9141 | SPCC330.10_DN | CAAGATGGAATGGCCCGCGT |
| 9142 | SPCC330.11_UP | TCCGTACGCGCTGGGTACAA |
| 9143 | SPCC330.11_DN | TATACCGCGCTGGCGTACAA |
| 9144 | SPCC330.12c_UP | TCGCGCCTCACCCTTCTCAT |
| 9145 | SPCC330.12c_DN | GGCAACAGCGGAGCAAGGAC |
| 9146 | SPCC330.13_UP | GCAGGAATCATCGGCGGGTA |
| 9147 | SPCC330.13_DN | TCTCGAATTGATGGCGCTGG |
| 9148 | SPCC330.14c_UP | AACACGCCTGATCCACCGCC |
| 9149 | SPCC330.14c_DN | CCGGTAGGGGCAAATCGAGC |
| 9150 | SPCC330.19c_UP | TGAAGGTCCTACGCGCAACG |
| 9151 | SPCC330.19c_DN | GTTCACCGTGTGACCCCTGA |
| 9152 | SPCC338.02_UP | CGACCCGCCACAAACACCAG |
| 9153 | SPCC338.02_DN | TCCTTACCGAGCCACCCCCG |
| 9154 | SPCC338.04_UP | TCGATGCCCACAACAAAGCC |
| 9155 | SPCC338.04_DN | ATAGGTTTCCTCTGTGCGCG |
| 9156 | SPCC338.06c_UP | CCAGGGAGCGACCCCAGTAA |
| 9157 | SPCC338.06c_DN | TCCGCAAGTGACATCCGCTC |
| 9158 | SPCC338.08_UP | TCTGGGGAAAACGCGCTGGA |
| 9159 | SPCC338.08_DN | GCCCGGACGAAGCATGAAAC |
| 9160 | SPCC338.10c_UP | CGACTCCCGGACCCAAAGGC |
| 9161 | SPCC338.10c_DN | TTCGGCGCTAAATCCGCTTC |
| 9162 | SPCC338.11c_UP | TTTTGACGCCCTCGCTCTGG |
| 9163 | SPCC338.11c_DN | TCGTGGATGGGAGAGATGCG |
| 9164 | SPCC338.12_UP | ACGCCAGACCCATACACGCA |
| 9165 | SPCC338.12_DN | CGCTTTCGCTCGTCCGTTCG |
| 9166 | SPCC338.13_UP | CCGAGAAGGATGGCGCTAGC |
| 9167 | SPCC338.13_DN | TTTCCTTCGGCCTTTTGCGC |
| 9168 | SPCC338.14_UP | AGCGGGGTAGGCAATTCGGA |
| 9169 | SPCC338.14_DN | CGCCGACCGACAAAAGCAAG |
| 9170 | SPCC338.15_UP | TCCCTCTCCCGCCCCTTAGT |
| 9171 | SPCC338.15_DN | AGAGGGAATGATGCGGATGG |
| 9172 | SPCC338.17c_UP | AGCCCCGCAGAAATGCTCAG |
| 9173 | SPCC338.17c_DN | CGCACCCTGCAAATCGATGA |
| 9174 | SPCC338.18_UP | TCGCTAACAGGGGGGCCAAA |
| 9175 | SPCC338.18_DN | CATAGCCGCCAGGCAACCAA |
| 9176 | SPCC364.01_UP | CTTGGCGTCGAGGGGTCTTG |
| 9177 | SPCC364.01_DN | CCCGTTTGATGACCCTGCGT |
| 9178 | SPCC364.03_UP | CGGTTGACGAGGGGGATTGC |
| 9179 | SPCC364.03_DN | CGTGGATGGGGGAAAACGA |
| 9180 | SPCC364.04c_UP | ACTCGGGTGGGTACTGGCGC |

FIG.52

| Sequence number | Name | Base sequence | Sequence number | Name | Base sequence |
|---|---|---|---|---|---|
| 9181 | SPCC364.04c_DN | CTGCTTGTGCCCCTCTCCCG | 9283 | SPCC548.07c_DN | GGAAGACGGGGGGTGCGAAT |
| 9182 | SPCC364.05_UP | CCAAGCAAAGGGCGCAACAC | 9284 | SPCC550.01c_UP | CGAAGCACCCAGCCCAATCA |
| 9183 | SPCC364.05_DN | ACCGAGCATAGGACCTGACG | 9285 | SPCC550.01c_DN | CAACGATTCATGAGCGCGGC |
| 9184 | SPCC364.06_UP | CCTCCTAGCCGCAACACCCA | 9286 | SPCC550.02c_UP | TGGGGGCGTAGGTGACGAGA |
| 9185 | SPCC364.06_DN | CGCCTAAACCCGCACAGCAC | 9287 | SPCC550.02c_DN | CAAGGCTAGGCGCTCACGAT |
| 9186 | SPCC364.07_UP | AATATGCGGGCGGTGGAAA | 9288 | SPCC550.03c_UP | CCCGGAGTACGGCTGCTACAA |
| 9187 | SPCC364.07_DN | CCGCGCTTGGTCTTCTTCGA | 9289 | SPCC550.03c_DN | AAGGCCAGTCGGCTGTTACA |
| 9188 | SPCC417.02_UP | GGCGAGGTGCAATGGGTGAG | 9290 | SPCC550.04c_UP | TGTCGCGATGGCCGATAACA |
| 9189 | SPCC417.02_DN | CCGCCAGTATGACCGACCCT | 9291 | SPCC550.04c_DN | TGTCGGCTACCGGGTCAACA |
| 9190 | SPCC417.03_UP | CTGCGTGGCTGAATGGATGC | 9292 | SPCC550.05_UP | CTCGCCCCACCTACCCCGAC |
| 9191 | SPCC417.03_DN | GAGAACCGCGCTGCACAAAC | 9293 | SPCC550.05_DN | CCATTTCATTAGCGGGGGGC |
| 9192 | SPCC417.04_UP | TGCGGCGTAGGGTTAAGGGC | 9294 | SPCC550.06c_UP | GCGTAAAAGGTGCGAGCCGT |
| 9193 | SPCC417.04_DN | CCGCCCCACATCCTGCCAA | 9295 | SPCC550.06c_DN | AAGACCCGCGCGGATAACAG |
| 9194 | SPCC417.05a_UP | AGGATACGCTAGTCGCCTGC | 9296 | SPCC550.07_UP | AGCAAGCCAAAGCCGGCAGA |
| 9195 | SPCC417.05a_DN | AGCACGACTCCTAGGTCGCA | 9297 | SPCC550.07_DN | GACGGGAAGGAGCGAGGAGG |
| 9196 | SPCC417.06c_UP | ATGGTCACGGCCCAAAACGG | 9298 | SPCC550.08_UP | GAATTCCGGTCCCTTGCCCT |
| 9197 | SPCC417.06c_DN | TCAGGCGAGGTGATGCGGAT | 9299 | SPCC550.08_DN | GAGGGATAAGCGCGAGCAG |
| 9198 | SPCC417.07c_UP | GCAGACGGCCTAAGTGGGGG | 9300 | SPCC550.09_UP | CTTGGAACATGTCGGCGCAA |
| 9199 | SPCC417.07c_DN | GAAAACGTCAAGCCCCCACC | 9301 | SPCC550.09_DN | ATGCACGGCTGCGCATACAA |
| 9200 | SPCC417.08_UP | TGCCCAAATTCCCCCCGTGA | 9302 | SPCC550.10_UP | GGATTGGGAGCTGGGAGGAG |
| 9201 | SPCC417.08_DN | CTTCGCCGTGGTGGGCTCTG | 9303 | SPCC550.10_DN | AGTGTTGACGTAGAGCGGCG |
| 9202 | SPCC417.09c_UP | CGCAGTCAAACCACCACGCT | 9304 | SPCC550.11_UP | TGAATGTGGGCTGCGGGGT |
| 9203 | SPCC417.09c_DN | TTTGGGTCTGTGTGCGGGG | 9305 | SPCC550.11_DN | CCACCTCTTTGGTCCCTCGC |
| 9204 | SPCC417.10_UP | ACCAGACGTTGTAACGCCGA | 9306 | SPCC550.12_UP | TTCGGGGTCGTAGGGTTCCA |
| 9205 | SPCC417.10_DN | TGACGCCACAGGTGATCGAG | 9307 | SPCC550.12_DN | TATGATGACACCGGCCTGCG |
| 9206 | SPCC417.12_UP | AGCGCGCGGGGTGTATGTAT | 9308 | SPCC550.13_UP | CCGATGTGTGAGGCGCACTT |
| 9207 | SPCC417.12_DN | CGATCATGGTAGCGGGGAGG | 9309 | SPCC550.13_DN | GCCACGAGGGACTCCGAAGC |
| 9208 | SPCC4B3.01_UP | TGTGATGCGCGCTGCAATGA | 9310 | SPCC550.14_UP | TGCCGCGTAGGTACGCACTA |
| 9209 | SPCC4B3.01_DN | GATTCCCGCATAGGCACGGA | 9311 | SPCC550.14_DN | CCTGCCATGACGTACCGACA |
| 9210 | SPCC4B3.04c_UP | ATGGATTGCGCAGAAGGCGT | 9312 | SPCC550.15c_UP | AGTCTCCCACTCCCCCGAAT |
| 9211 | SPCC4B3.04c_DN | CCCTTTGACCCGTTCCCGTC | 9313 | SPCC550.15c_DN | AGAAAGACGCAACCAACCCG |
| 9212 | SPCC4B3.05c_UP | GCAACGATGACCGAAGCCT | 9314 | SPCC553.02_UP | CCTCCAATCCTCACCTCGGC |
| 9213 | SPCC4B3.05c_DN | GCCCCTACCCATTCGACCTT | 9315 | SPCC553.02_DN | TGGGAAACAACGTCGGAGGA |
| 9214 | SPCC4B3.06c_UP | ACCCGAAACAACTGGCUACT | 9316 | SPCC553.03_UP | TTGCTGTGGCGGAATGTGGA |
| 9215 | SPCC4B3.06c_DN | AGGCACTAACGCAGACCGGC | 9317 | SPCC553.03_DN | ACGACGACCCACGGACATC |
| 9216 | SPCC4B3.07_UP | ACCGTGCTCCTGCTTTGCCC | 9318 | SPCC553.04_UP | CCGTGCCACAAGCGTAGCGA |
| 9217 | SPCC4B3.07_DN | TTGTCCCGGAACACGCTGTA | 9319 | SPCC553.04_DN | AACCGATGGAAGGGCGCTTT |
| 9218 | SPCC4B3.08_UP | AGGGCCCGGTGGTATTAGGG | 9320 | SPCC553.06_UP | AGGGCGGTACCGGGATTTTG |
| 9219 | SPCC4B3.08_DN | GATGTGCTTCAGAGGGCGCC | 9321 | SPCC553.06_DN | TCAGTCCATCCGCTATCGCC |
| 9220 | SPCC4B3.09_UP | TGCGGTGCTAGGGTGATTCG | 9322 | SPCC553.07c_UP | GTCGCCATCCCCTAGCTCCA |
| 9221 | SPCC4B3.09c_DN | AIGGCGCTCCGGTACGACTA | 9323 | SPCC553.07c_DN | GCACGAATGAGACAGGGCGC |
| 9222 | SPCC4B3.10c_UP | TTACAATGCGGGGGTCGCTT | 9324 | SPCC553.08c_UP | AGCCTAATTGCGAGCGGTCG |
| 9223 | SPCC4B3.10c_DN | GCACGCAATGCCCTACGTCAA | 9325 | SPCC553.08c_DN | CGGTCTTGGATATCGCCCCA |
| 9224 | SPCC4B3.11c_UP | TCCCAAAAGGCACCCCAAAC | 9326 | SPCC553.09c_UP | TGTGCACGGTGTCGCCATTA |
| 9225 | SPCC4B3.11c_DN | TATCGCCGTATTCGGGCAGG | 9327 | SPCC553.09c_DN | ACACGATCTGACGCGTGTGG |
| 9226 | SPCC4B3.12_UP | AGGGCACGGGTAGAAGGCGT | 9328 | SPCC553.11c_UP | CACTGGATAACGAGGGCCGG |
| 9227 | SPCC4H3.12_DN | AGGTGAACGAAGGGCGGTT | 9329 | SPCC553.11c_DN | CCTGAACCCCCCGACAGACG |
| 9228 | SPCC4H3.13_UP | CTGCTCCCGTCGCGGGCTTA | 9330 | SPCC569.02c_UP | AAACAACAACCGCAACCGCC |
| 9229 | SPCC4B3.13_DN | GCGTCCGCACCTGCTGCTAA | 9331 | SPCC569.02c_DN | GCAGGGCGCCGAAACGATAC |
| 9230 | SPCC4B3.14_UP | CGGGGGCAGGTTCAGGGTAG | 9332 | SPCC569.03_UP | CGGATGGCCCTATTGCACAC |
| 9231 | SPCC4B3.14_DN | CCCATTCAACGGCCCAAGC | 9333 | SPCC569.03_DN | TTGTTGCGGCTATGTCGGGG |
| 9232 | SPCC4B3.15_UP | AAAATACCCCGTGCGTCGC | 9334 | SPCC569.04_UP | CGAAGGCGGCGATTAATGGA |
| 9233 | SPCC4B3.15_DN | TTCTTCATGCCTGCCCACCA | 9335 | SPCC569.04_DN | GTGGCTACTCGGACGGGGGG |
| 9234 | SPCC4B3.16_UP | GGGTGGTAAGGTGGGAGGGC | 9336 | SPCC569.05c_UP | CAAGGGCGTATCCACGCGAA |
| 9235 | SPCC4B3.16_DN | CCCGCGCAAAGAAAGTACCC | 9337 | SPCC569.05c_DN | TGCCATAAGGCTTAGCGCCC |
| 9236 | SPCC4B3.17_UP | ACGGACCGAAATGAACCGCC | 9338 | SPCC569.06_UP | TTCCCCGCTCTCCGCTCTTC |
| 9237 | SPCC4B3.17_DN | CCGGGGTTTAGCTGGCGAG | 9339 | SPCC569.06_DN | GTCCCACCGTACAGGTCACA |
| 9238 | SPCC4F11.02_UP | AACGCTGGGGGATTTGTGGC | 9340 | SPCC569.07_UP | GCGCCGAAGGAGGGCATAGC |
| 9239 | SPCC4F11.02_DN | CGGAGGGGTCACGAAAGACG | 9341 | SPCC569.07_DN | CTTGAGATTTCGGGCGAGGA |
| 9240 | SPCC4F11.03c_UP | TCCGGGTGGGGTGCTATGAT | 9342 | SPCC576.02_UP | TGCCAGAGTCGGCTGTACAA |
| 9241 | SPCC4F11.03c_DN | TTTCCGATAGCCGAGTGCCC | 9343 | SPCC576.02_DN | TCCGTGTTCCCGGGTTAAGG |
| 9242 | SPCC4F11.04c_UP | AATACCAAACATGCGCCCCG | 9344 | SPCC576.03c_UP | CCCCCACAGAATGAGCCCCA |
| 9243 | SPCC4F11.04c_DN | GCAGGGAGGGGCGAAGGTTG | 9345 | SPCC576.03c_DN | CCGTGGTGCTGCCTCGTTGAC |
| 9244 | SPCC4G3.02_UP | TCAGTCGGGGGATTTGGGTC | 9346 | SPCC576.04_UP | CCCCTCTGGCCCCTCGTTAC |
| 9245 | SPCC4G3.02_DN | TATGCATCACACCGCCGTGC | 9347 | SPCC576.04_DN | CACCACCCCGCGTTCCCTCCC |
| 9246 | SPCC4G3.03_UP | GGCTGGTCAAAAGTGGGGGG | 9348 | SPCC576.05_UP | AGTGTGGTGGGGGGGGACA |
| 9247 | SPCC4G3.03_DN | ACTCCGCCCCATCTGACCG | 9349 | SPCC576.05_DN | TCCCGACTCCACCGTTTGCC |
| 9248 | SPCC4G3.04c_UP | TGTACCGACCCTTGACCCCC | 9350 | SPCC576.07_UP | TCGGTTAAGCGCAGGGCAGG |
| 9249 | SPCC4G3.04c_DN | GGGAGGCGTAACATGGGCAA | 9351 | SPCC576.07_DN | GATGGCGCATAGCTAGCCCA |
| 9250 | SPCC4G3.05c_UP | TGCCTCCTCCTGCCGGAATG | 9352 | SPCC576.08c_UP | CGCCAACCCGCTTTACTCGC |
| 9251 | SPCC4G3.05c_DN | TGCCTATTCGCCGCTCACTG | 9353 | SPCC576.08c_DN | ACCCCCGTCCCCTGTCCAAG |
| 9252 | SPCC4G3.06c_UP | AACAGGCGGACGGGCATAAG | 9354 | SPCC576.09_UP | TCTCGCCCCGGAATCATCCG |
| 9253 | SPCC4G3.06c_DN | GTGGGGGCAGGGCGTTGTCT | 9355 | SPCC576.09_DN | GGGTGACGTATCGGCGATGT |
| 9254 | SPCC4G3.07c_UP | AGCAGAAACCACGCCAACGA | 9356 | SPCC576.10c_UP | TCTGACCGCGCAACTGAG |
| 9255 | SPCC4G3.07c_DN | ATGGAGGAGGGTGGACTGCG | 9357 | SPCC576.10c_DN | GTGTAACTGCCCCCCTCGGA |
| 9256 | SPCC4G3.08_UP | CACCACCTCCGGACGACCT | 9358 | SPCC576.11_UP | CAAAGACCCGCCCCGACTGT |
| 9257 | SPCC4G3.08_DN | CCAACGCCTGCTCCATTCTG | 9359 | SPCC576.11_DN | TTGGGCTTGGTTTTTGCCGC |
| 9258 | SPCC4G3.09c_UP | CACGGAGATGCGAAACCAGC | 9360 | SPCC576.12c_UP | CGAGTTACGGCTCCTCGGCAT |
| 9259 | SPCC4G3.09c_DN | GTGCCCCTGACGCTCATTCAGA | 9361 | SPCC576.12c_DN | CCATTTACGCAACTCCCGCA |
| 9260 | SPCC4G3.11_UP | CGCACAAACAGACCGGCTAC | 9362 | SPCC576.13_UP | GCTAGGGAGGTTGGCGCATG |
| 9261 | SPCC4G3.11_DN | ATGGCGTCGTTTGGCTTGTG | 9363 | SPCC576.13_DN | GGTGCTCCCCGCCTGAAATT |
| 9262 | SPCC4G3.13_UP | TAGGTGCTTTGGCGGAGGGT | 9364 | SPCC576.14_UP | ACCCAACGAACGATCACCGC |
| 9263 | SPCC4G3.13c_DN | GACTGGGGCGGTGCTTTGTC | 9365 | SPCC576.14_DN | ATTTGGTTGGGGGATGGGGG |
| 9264 | SPCC4G3.14_UP | TGCTTTGCCGTTGTCCCCAG | 9366 | SPCC576.15c_UP | AACAGCCAAAACCAGGGGC |
| 9265 | SPCC4G3.14_DN | TGCGAGAAGCGAGGGCGGTA | 9367 | SPCC576.15c_DN | TTTCTGTCTTCCCCGGCCGA |
| 9266 | SPCC4G3.15c_UP | CCACTCTTTTCCCACCCCGC | 9368 | SPCC576.17_UP | AGTACGCGCACGGTACATCT |
| 9267 | SPCC4G3.15c_DN | CAAGCAGCTCGGAGACCGTT | 9369 | SPCC576.17c_DN | GAACAGGCTCTTCACGGGGA |
| 9268 | SPCC4G3.16_UP | GCGCCCCCTCCCTGACACAT | 9370 | SPCC584.01c_UP | GAGCCTGCGAAAATGGCCTA |
| 9269 | SPCC4G3.16_DN | TTCGTTTAGTCGCCCGCCT | 9371 | SPCC584.01c_DN | CTGGTGTCATGGTGGGCCGG |
| 9270 | SPCC4G3.17_UP | TGTGGGTACGGTGCGGAAGG | 9372 | SPCC584.02_UP | CGCTACACCCGACCGACTCA |
| 9271 | SPCC4G3.17_DN | GTGATACGGCAGCGGGGAAT | 9373 | SPCC584.02_DN | GCAACCCGCAAGGTATTCA |
| 9272 | SPCC4G3.18_UP | CCCCCTGCCAATGCCTTAAA | 9374 | SPCC584.03_UP | TGGGGCGCGCATTCTTGTAC |
| 9273 | SPCC4G3.18_DN | GTTTTCCCCGCGTTTAAGGCC | 9375 | SPCC584.03_DN | CATCGCCCACATTAGCACCG |
| 9274 | SPCC4G3.19_UP | ATTCTCTCGGGCTGGCGGTGG | 9376 | SPCC584.04_UP | GGGGATTTCAGGGCCAGAGG |
| 9275 | SPCC4G3.19_DN | CGGAACGGCAGACAGGACGG | 9377 | SPCC584.04_DN | ATTCGTGGGGGGGGTTGAACA |
| 9276 | SPCC548.04_UP | ACAACGACCCCTGCCTTCCG | 9378 | SPCC584.11q_UP | TCGAACCAACCATAGGCCCC |
| 9277 | SPCC548.04_DN | GAAGGCAGGGGTGGAAGGCAC | 9379 | SPCC584.11c_DN | TTTTGGCGGCTGCGTTCTTG |
| 9278 | SPCC548.05c_UP | TGTCCCCGTAACCACGCCTA | 9380 | SPCC584.12_UP | CGCGGACTACAAGCACCACGG |
| 9279 | SPCC548.05c_DN | CCGTCCACCTCCGTTCCGCT | 9381 | SPCC584.12_DN | CGATGGGTGGTTTTTGGAGA |
| 9280 | SPCC548.06c_UP | AGGGAGGGAACCAAACGGGA | 9382 | SPCC584.13_UP | TGCTCGGTCGCTCTCGCTG |
| 9281 | SPCC548.06c_DN | GCAATGGGGGGGTCGTGAGG | 9383 | SPCC584.13_DN | TGCGGGGGATTCAGGCGGTTA |
| 9282 | SPCC548.07c_UP | CAACCCCACCGAAAATCCGC | 9384 | SPCC584.14_UP | GACGACACCCAGCACCAGCA |

FIG.53

| Sequence number | Name | Base sequence |
|---|---|---|
| 9385 | SPCC594.14_DN | CAACCACCCAACGGCAATCG |
| 9386 | SPCC594.15c_UP | ACAAACAATGGTGCGCGGC |
| 9387 | SPCC594.15c_DN | TCCCCTGATAATTGGCCCCG |
| 9388 | SPCC594.02c_UP | ACAAGCGTCAGGGGGTCGTC |
| 9389 | SPCC594.02c_DN | GCTAGCCCAACCATTCGCCC |
| 9390 | SPCC594.03_UP | GGCAAAACGCGGATCGAGC |
| 9391 | SPCC594.03_DN | TGTATTTGCCGCCTTTCCC |
| 9392 | SPCC594.04c_UP | TCGCCGTTTAGTGAGCCCGC |
| 9393 | SPCC594.04c_DN | ATGGATGGGACTTCGCGGAC |
| 9394 | SPCC594.05c_UP | TGGAATCGGGGGAGTTGGAC |
| 9395 | SPCC594.05c_DN | CCGTGAAACACCCCGCCTTT |
| 9396 | SPCC594.06c_UP | TCGCCGTGGTCATCCCTCCT |
| 9397 | SPCC594.06c_DN | CTCAAGGAATGGGGAACCGC |
| 9398 | SPCC594.07c_UP | ACGGACGATTGCGGGGTTAC |
| 9399 | SPCC594.07c_DN | TTAGTGCGCGAGACACTCC |
| 9400 | SPCC5E4.03c_UP | TGCCGGCTAGTCGGTGGTGA |
| 9401 | SPCC5E4.03c_DN | ACTCGAGCCAGCACCCGGAC |
| 9402 | SPCC5E4.05c_UP | CTGTGGGCGGATAACGTCGA |
| 9403 | SPCC5E4.05c_DN | ATCACCTTCGCGGCCTTACG |
| 9404 | SPCC5E4.06_UP | CCGCTGCCGAACCCATAGAC |
| 9405 | SPCC5E4.06_DN | CCAGAGGGGTGGTGCGATGA |
| 9406 | SPCC5E4.07_UP | GGCAGGCGAATGCGAAATGC |
| 9407 | SPCC5E4.07_DN | GGCTAAAAGTGCCCACGGGAT |
| 9408 | SPCC5E4.10c_UP | AACCCATTTCCACCGCTCGT |
| 9409 | SPCC5E4.10c_DN | GCAAATGAAGGAAGCCGGCT |
| 9410 | SPCC61.01c_UP | CCCCGCTTGTCGTCCCCATA |
| 9411 | SPCC61.01c_DN | TGACTGAGAGGGCGTTCGGCC |
| 9412 | SPCC61.02_UP | ACCCGTGTCGGGTAACCTTC |
| 9413 | SPCC61.02_DN | TCTCGATAGGCATCGCACCC |
| 9414 | SPCC61.03_UP | ATCCCGTGTCCCGTTCTCCC |
| 9415 | SPCC61.03_DN | CGGGACAATGGGGCTGGCTT |
| 9416 | SPCC61.05_UP | TCGAGCGCTACGTTCCAGAC |
| 9417 | SPCC61.05_DN | ACGGCTCCCTAGAGCAGAGA |
| 9418 | SPCC613.02_UP | TCCGGCCGACGCTGTGTATG |
| 9419 | SPCC613.02_DN | ACGCGGCAAGGTCATGAATG |
| 9420 | SPCC613.03_UP | CCAAGGGCATCAGGCGGTGT |
| 9421 | SPCC613.03_DN | TCCGCCAATCCAAACGTCG |
| 9422 | SPCC613.05c_UP | GAGCGCGCGGAATTGTGATG |
| 9423 | SPCC613.05c_DN | AAGCCCTCCGCAAACGTGTG |
| 9424 | SPCC613.06_UP | AGCGAATCGGGGCGTGAGTC |
| 9425 | SPCC613.06_DN | GATTTGCTTCGAAGGGGCC |
| 9426 | SPCC613.07_UP | GGTGTCGGGTTCCTTCTCCG |
| 9427 | SPCC613.07_DN | CCGTGTCCCCTGCCCTTACC |
| 9428 | SPCC613.08_UP | CGGAGGCGAAGAGGGGTAAG |
| 9429 | SPCC613.08_DN | CGAGCGAAAACACCGGGAAT |
| 9430 | SPCC613.09_UP | CCCTCATCTGCCCCAAAATG |
| 9431 | SPCC613.09_DN | TTGACGGGGCGTAGGTGAT |
| 9432 | SPCC613.10_UP | GGTGGTCATCGGGAACGACT |
| 9433 | SPCC613.10_DN | CCGTACTCCGTAGTCGGACA |
| 9434 | SPCC613.11c_UP | CACATACCCCCCAACGGCA |
| 9435 | SPCC613.11c_DN | TCTTGCCCCCATGAGACCGG |
| 9436 | SPCC613.12c_UP | GAGGGCGTCGCTGAAGATGA |
| 9437 | SPCC613.12c_DN | CGATTGGCGTCGCTCGATGA |
| 9438 | SPCC622.01c_UP | CCCCACGGCATTCATTACC |
| 9439 | SPCC622.01c_DN | CGAACCGATCACTGCCGAAA |
| 9440 | SPCC622.02_UP | TGGCTGGTCTCGGGGCTCTC |
| 9441 | SPCC622.02_DN | ACGTTTGTGCCCGTGAACCG |
| 9442 | SPCC622.03c_UP | CCCGGATCAACAACCCACGT |
| 9443 | SPCC622.03c_DN | GCTFCCCCGTCATCCTTTGC |
| 9444 | SPCC622.04_UP | TGCGGATATTCTGGCGCACG |
| 9445 | SPCC622.04_DN | TGGTTCGGCGCGGGCTAGTA |
| 9446 | SPCC622.06_UP | GGGGCGTGTGATGTCGATGG |
| 9447 | SPCC622.05_DN | CTCGGCCCCCCTACTTCGCA |
| 9448 | SPCC622.07_UP | AGTGCAGGAGAGGGGCGAATC |
| 9449 | SPCC622.07_DN | AAACAAAACACGGTGCCTGC |
| 9450 | SPCC622.08c_UP | CCGAGGGTTATCGACGAGGG |
| 9451 | SPCC622.08c_DN | TGCGGACGGGTAGGAATTGG |
| 9452 | SPCC622.09_UP | ATTGCGGGGCTCTAAGGGCT |
| 9453 | SPCC622.09_DN | TAAGCGATGGCCGGAAGAGG |
| 9454 | SPCC622.10c_UP | GGAATGGCGAGAATGCGGAG |
| 9455 | SPCC622.10c_DN | CGTGTAGGGCGCTGCTTGGA |
| 9456 | SPCC622.11c_UP | CTCGACTCCCGCAACAAGCC |
| 9457 | SPCC622.11c_DN | TTTGCTGCCAAGGTGCGTGC |
| 9458 | SPCC622.12c_UP | TAAAGCGCCGCGCGAGCAGG |
| 9459 | SPCC622.12c_DN | TTCGTCTCGGGGTGGCTGCT |
| 9460 | SPCC622.13c_UP | TCGTTCTGTCGCTGTGCAT |
| 9461 | SPCC622.13c_DN | CCCGAACCACAGCGACACCC |
| 9462 | SPCC622.14_UP | CCGCCTCCCCGCCTAAAAAC |
| 9463 | SPCC622.14_DN | ACCGCCGAACCCTGACCTCC |
| 9464 | SPCC622.15c_UP | TGATGGCGTCCGAGGTGAAG |
| 9465 | SPCC622.15c_DN | AGCCGATTATGGCGGCAAG |
| 9466 | SPCC622.16c_UP | GACCTGCGAACCCCCTCCTC |
| 9467 | SPCC622.16c_DN | AACAGCTTGGTCGGGCAGGA |
| 9468 | SPCC622.17_UP | GGTGGGCGGTTGGGGTCACT |
| 9469 | SPCC622.17_DN | TCACGGGGTTCGTTCAGCAC |
| 9470 | SPCC622.18_UP | TTGGACAGGCGGACTGCTCG |
| 9471 | SPCC622.18_DN | TGCCCATCATCCGCAGTAC |
| 9472 | SPCC63.02c_UP | ACGGTGCCCTCATTTTCGGA |
| 9473 | SPCC63.02c_DN | ACGGCATGGTCGCCGTTCAC |
| 9474 | SPCC63.03_UP | CACCGCCAAGAATCCACGCA |
| 9475 | SPCC63.03_DN | AGTGATCGGCACGGTTGCAT |
| 9476 | SPCC63.04_UP | ACCGGCGCTGTGCCAATAAA |
| 9477 | SPCC63.04_DN | GGGTCTACGGCCACATGCT |
| 9478 | SPCC63.05_UP | CGACGCACCCGGACTCATTTG |
| 9479 | SPCC63.05_DN | AAAAGGCACCAGGCCCAGC |
| 9480 | SPCC63.06_UP | CGGTGACAAGAGGGGCGAGT |
| 9481 | SPCC63.06_DN | GCAGCCGTCCACACCACCCT |
| 9482 | SPCC63.07_UP | ACCTATCCCCGTCCCGGCTTG |
| 9483 | SPCC63.07_DN | CAGGTTAAGATGGCGGGGGG |
| 9484 | SPCC63.08c_UP | TCCGTTGGTAGCCCTCGCTT |
| 9485 | SPCC63.08c_DN | CGTTGGATTCACGCACCCG |
| 9486 | SPCC63.10c_UP | AGGGGAGGCGCTGAATGCAAT |
| 9487 | SPCC63.10c_DN | CGGGTGGGCGGATCGTGATA |
| 9488 | SPCC63.11_UP | CTGACCCTAGAGACCGCGCC |
| 9489 | SPCC63.11_DN | CGTTTACCGTCCCGCCACAG |
| 9490 | SPCC63.12c_UP | ACGGTGTCTGACGTGTCTC |
| 9491 | SPCC63.12c_DN | TCTGTGTGCCGGGTGGAAGG |
| 9492 | SPCC63.13_UP | TACCCGTTCCTGCATTCCGC |
| 9493 | SPCC63.13_DN | CACGCCAGTCTCCCCCTCAT |
| 9494 | SPCC63.14_UP | GGACGGGCAAGCAGGTTTCA |
| 9495 | SPCC63.14_DN | CGTGGCGCGGGGAATAGTA |
| 9496 | SPCC645.02_UP | ACACGGCGGGACGGACATA |
| 9497 | SPCC645.02_DN | CTCTTGATCCGACCGGCCAG |
| 9498 | SPCC645.04_UP | GACGAAACGCAGACCCCGAA |
| 9499 | SPCC645.04_DN | AATGCACCGACCCACGAGCC |
| 9500 | SPCC645.05c_UP | AGTGGGGCAACGTTAGGGCA |
| 9501 | SPCC645.05c_DN | GAAAACGGAGAAGGGCTGCG |
| 9502 | SPCC645.07_UP | AATCATCACCGCGCACACGT |
| 9503 | SPCC645.07_DN | CCAGAGGGATTTCCCCGATC |
| 9504 | SPCC645.08c_UP | GGGACATCCGTACGGCACAT |
| 9505 | SPCC645.09c_DN | GGTTGTGCCGCGGAAATAGGG |
| 9506 | SPCC645.09_UP | TCGCCCACAAGCATCCATCG |
| 9507 | SPCC645.09_DN | AGTCCAGGCCCCCCCAACTA |
| 9508 | SPCC645.10_UP | TTAGCGGGTCGTTGTTGGCG |
| 9509 | SPCC645.10_DN | TTCACTCGTTACCCCCCCA |
| 9510 | SPCC645.11c_UP | AAACGGGGTGACGGTGGCTG |
| 9511 | SPCC645.11c_DN | CGGCAGGTCCCCTAAGTAGA |
| 9512 | SPCC645.12c_UP | CGGGATGGGGACGGATTTTC |
| 9513 | SPCC645.12c_DN | CGGGGTTGGGGAGGCTAGAA |
| 9514 | SPCC645.13_UP | ACTAACTACCCCCCCGAGC |
| 9515 | SPCC645.13_DN | GTCGGTGTGGAAGGCCGAAG |
| 9516 | SPCC645.14c_UP | AGGGACAGCGGACCTTGGTG |
| 9517 | SPCC645.14c_DN | AGTTGGGCGCATGGTGACA |
| 9518 | SPCC663.02_UP | CCTTAACAGCCATCGCGCCC |
| 9519 | SPCC663.02_DN | CCCAACATCTCCCCAAGGCA |
| 9520 | SPCC663.03_UP | CTGTCCCACCCCGCAAAATC |
| 9521 | SPCC663.03_DN | CGATGAAGAACGCCGCCCGT |
| 9522 | SPCC663.04_UP | GGGGCACGGCTGTAATCGAG |
| 9523 | SPCC663.04_DN | ACGCCGCCACTGACGAAATG |
| 9524 | SPCC663.05c_UP | TTGTCGTGCACCCAGGTCAA |
| 9525 | SPCC663.05c_DN | ATTGGGCTGCCTGCAAGCGT |
| 9526 | SPCC663.06c_UP | TCCATAACACAGTCGCGGGG |
| 9527 | SPCC663.06c_DN | GGGTGTCTCCGATCTTGGCG |
| 9528 | SPCC663.08c_UP | AACGACGGAACAAAGCGCAA |
| 9529 | SPCC663.08c_DN | GGCGTGGTCGGTTCTGTCA |
| 9530 | SPCC663.09c_UP | AACGAAGGGGAGTAACCGA |
| 9531 | SPCC663.09c_DN | TCCTCCATTCGGCCGTTCAG |
| 9532 | SPCC663.10_UP | GGATCGGCGCTAGGGGGTTGC |
| 9533 | SPCC663.10_DN | CCCCTCTCGCATCGGTTTCA |
| 9534 | SPCC663.11_UP | TAGGGCGTAGGGGTCGGGA |
| 9535 | SPCC663.11_DN | CGCCACAAAATCAGCACGAG |
| 9536 | SPCC663.12_UP | ACCACCATCCAATTCCCGCA |
| 9537 | SPCC663.12_DN | CCGCGACCGATTTTACCCCC |
| 9538 | SPCC663.14c_UP | ATCTTCGCGCTCCCGTTTCG |
| 9539 | SPCC663.14c_DN | ATCGCCCACCGCCTCACAAA |
| 9540 | SPCC663.15c_UP | CGTTTAAGGGCGGATGCTCC |
| 9541 | SPCC663.15c_DN | CTTTGACCGATTGGGCGTG |
| 9542 | SPCC70.02c_UP | TCGGAGAGGTCGGTTCTGGG |
| 9543 | SPCC70.02c_DN | GGATTGTGGCAGGGGGTT |
| 9544 | SPCC70.03c_UP | TGTGGTGCTGGAGGTGGGAG |
| 9545 | SPCC70.03c_DN | CCCATGCACCGATCCCCCT |
| 9546 | SPCC70.04c_UP | TGCTTCCCACACCCTACTGCC |
| 9547 | SPCC70.04c_DN | TCCGTGCTGTCGTCTTTCCG |
| 9548 | SPCC70.05c_UP | CCGGAAGGCCGTAATTGCAGC |
| 9549 | SPCC70.05c_DN | CCGCCGCCGTTAAAGCTACC |
| 9550 | SPCC70.08c_UP | CGTTACCGTTGCCGCTTCG |
| 9551 | SPCC70.08c_DN | ACATGGGGTCGTGCTCGCT |
| 9552 | SPCC70.10_UP | GGACATCTTGCGGGACCAT |
| 9553 | SPCC70.10_DN | GATTTCCACCCCCCTCTGCG |
| 9554 | SPCC736.02_UP | AACCAGAGGGGGCACAGCT |
| 9555 | SPCC736.02_DN | AGTGGGGTTGGGGGGATGGA |
| 9556 | SPCC736.03c_UP | TCGTGCCTCCTTTCGTTGGG |
| 9557 | SPCC736.03c_DN | CTTCAACTCGGCGCGCAAAC |
| 9558 | SPCC736.04c_UP | GAGCGGAAGCGCCATGCACTT |
| 9559 | SPCC736.04c_DN | CCAACGGAAGCGCCTCGAAGC |
| 9560 | SPCC736.05_UP | CATAGTTTCGCGCCCGTGCT |
| 9561 | SPCC736.05_DN | ACGTCGGGCAAGCGGCATGT |
| 9562 | SPCC736.06_UP | CAGCGAAAGGGCGGGAAGAGG |
| 9563 | SPCC736.06_DN | GGCTACCTGACCGGCCTGGA |
| 9564 | SPCC736.07c_UP | ACGAAAACGCACCCCACTC |
| 9565 | SPCC736.07c_DN | CGGTGGTTCGGATGGTTCTG |
| 9566 | SPCC736.08_UP | CACACTGCCCGTTTTTGAT |
| 9567 | SPCC736.08_DN | AGGCCGGCGTTGCAAGTTTA |
| 9568 | SPCC736.09c_UP | CTAGCCGGCCGTCACCAAAA |
| 9569 | SPCC736.09c_DN | AACAAGCGGTGCCGCACGATG |
| 9570 | SPCC736.10c_UP | TGCTGGTCCTTGGGGATGTG |
| 9571 | SPCC736.10c_DN | GGTGGGCAAAGTGGGTCGT |
| 9572 | SPCC736.11_UP | ACCCATATACCTCCCGGGCA |
| 9573 | SPCC736.11_DN | TGGGCAATCATAGCCGGGCA |
| 9574 | SPCC736.12c_UP | AATGGGCAACAACGAACCGG |
| 9575 | SPCC736.12c_DN | ATCCTGCCTGCTCCTACCGC |
| 9576 | SPCC736.13_UP | GCCGGGGTGTCAGTCGAGAT |
| 9577 | SPCC736.13_DN | GCCCACCCACCGTAACCGAA |
| 9578 | SPCC736.14_UP | TACGGGGTGGCGAGTGGTTC |
| 9579 | SPCC736.14_DN | TAGGCCGGTCGCATTATTC |
| 9580 | SPCC737.02c_UP | CGGGGTAGGAGGGTAGTGCG |
| 9581 | SPCC737.02c_DN | TCTTGCTATCCATCCGCGGC |
| 9582 | SPCC737.03c_UP | TGGCGAAGGAAAGGCGATCA |
| 9583 | SPCC737.03c_DN | GACCGGATTGGGCCTTACG |
| 9584 | SPCC737.04_UP | ACTGTCCCGCTGTGCTCGTT |
| 9585 | SPCC737.04_DN | CATACAACTCCGTCCGCGCC |
| 9586 | SPCC737.05_UP | GAGCTAGATCGGGGCGGTG |
| 9587 | SPCC737.05_DN | CCTCGGGTGTTGGGAGTA |
| 9588 | SPCC737.06c_UP | ATTAFCACCGGGACAGCGCG |

FIG.54

| Sequence number | Name | Base sequence |
|---|---|---|
| 9589 | SPCC737.06c_DN | CCCAAGGTCAAGGCGTCCAC |
| 9590 | SPCC737.07c_UP | CGTGGCCCTGCGGTTTGTTT |
| 9591 | SPCC737.07c_DN | ATTCCGTCCTCATTGCCCCG |
| 9592 | SPCC737.08_UP | CAAACGACAGCGGCATTGCA |
| 9593 | SPCC737.08_DN | ATTGTGGTGCCGACCGGGTT |
| 9594 | SPCC74.01_UP | CTAACCCGCCGTCGTCACCC |
| 9595 | SPCC74.01_DN | CTAGCCGCCCCACCATTTCA |
| 9596 | SPCC74.02c_UP | ACAAACGGCGGAGTGCAGGC |
| 9597 | SPCC74.02c_DN | TCACTCCTCGCCCCAAACGG |
| 9598 | SPCC74.03c_UP | TAATGCCAAGGGACGGCAGG |
| 9599 | SPCC74.03c_DN | TTTTCCTGACCAACGCCGAG |
| 9600 | SPCC74.04_UP | GCTGGTGTCGTTGGCGAGGT |
| 9601 | SPCC74.04_DN | GGCGGGTAAGCGTCGGAAAT |
| 9602 | SPCC74.05_UP | AAAAGAGTCCAACGCCCGCA |
| 9603 | SPCC74.05_DN | CTCGTTCGCCCAATGCTCAA |
| 9604 | SPCC74.09_UP | TGCAGGTTATGACGTGCCCT |
| 9605 | SPCC74.09_DN | GAGCAAGTGAGGTGCCTCGT |
| 9606 | SPCC757.02c_UP | TAAGGGGGGTCGGAAAGGT |
| 9607 | SPCC757.02c_DN | CTTAACGCCCTACGCCCGGA |
| 9608 | SPCC757.03c_UP | GTAATGCAAATCCGGGGCCG |
| 9609 | SPCC757.03c_DN | CGCTGTACCGGTCCCTGCTT |
| 9610 | SPCC757.04_UP | CGCCAACCATCCGCACTTCC |
| 9611 | SPCC757.04_DN | TGGGGGGAGAACGGGTGAGC |
| 9612 | SPCC757.05c_UP | GCTCGTTTCTTGCCCGCCTA |
| 9613 | SPCC757.05c_DN | CGCTCCCACTTACCCCATGC |
| 9614 | SPCC757.07c_UP | ACCCGAGGCGACTCGCTTTT |
| 9615 | SPCC757.07c_DN | ACCCTGCCTAGGGACACCTT |
| 9616 | SPCC757.08_UP | GCGATGGAGGGTAGGGGCAA |
| 9617 | SPCC757.08_DN | GATGGAAGAAGGCGGCGGAT |
| 9618 | SPCC757.09c_UP | ATACGCTAGGCAGACCACGC |
| 9619 | SPCC757.09c_DN | GCGTGGATACCTGAGTGCCA |
| 9620 | SPCC757.11c_UP | CTCGTTCTCGATGCGGACCGG |
| 9621 | SPCC757.11c_DN | ACAACACGAGCCCCACCCTC |
| 9622 | SPCC757.12_UP | CTCAATGCGCGCGACCCTAC |
| 9623 | SPCC737.12_DN | GGGTGGACATGAGGTGAGCG |
| 9624 | SPCC757.13_UP | TCGCACCCTAGGGGTATCCA |
| 9625 | SPCC757.13_DN | TACACCGGACTCCGTGAGCA |
| 9626 | SPCC777.02_UP | CCCGCCGCTATTCTTCTCGC |
| 9627 | SPCC777.02_DN | GGGACGGTGGAACATCAGGG |
| 9628 | SPCC777.03c_UP | CCCACGCTAGCCCACAACCG |
| 9629 | SPCC777.03c_DN | CCCGTTCCGCGTAGCTGTTG |
| 9630 | SPCC777.04_UP | ATGGGATGCGTTGGGTTCCG |
| 9631 | SPCC777.04_DN | GCGTGGTCTTCGAGCGGGTG |
| 9632 | SPCC777.05_UP | CAAGATTGGGGCGGGGAGT |
| 9633 | SPCC777.05_DN | GGATGGGGGGGTCTAATGGG |
| 9634 | SPCC777.06c_UP | TCGTTAACGATGGGGCGAGC |
| 9635 | SPCC777.06c_DN | TGCCTCCGCTAAATTTCCCC |
| 9636 | SPCC777.07_UP | ATGGGGGGACGTTAACGGCA |
| 9637 | SPCC777.07_DN | GCGGGTCGTGCCTGGAAGTT |
| 9638 | SPCC777.08c_UP | TGGTAAAAACGCGTGCCTGC |
| 9639 | SPCC777.08c_DN | CCACTGCATGCTTGACCCGC |
| 9640 | SPCC777.09c_UP | CACCTCGAAGAACCCAGCCC |
| 9641 | SPCC777.09c_DN | AAACCACCACCACCCCCAGT |
| 9642 | SPCC777.10c_UP | CCACACCCCGCCATCAAGTC |
| 9643 | SPCC777.10c_DN | CGCGGGCTCTTCATCGTGTG |
| 9644 | SPCC777.11_UP | GTTCGTGTGGGCATGGGGTC |
| 9645 | SPCC777.11_DN | AACAGAGACGACACGGGAGG |
| 9646 | SPCC777.12c_UP | GAGGTAGACGGTGCGCGGGG |
| 9647 | SPCC777.12c_DN | CACTTACCACAGGCCCACACT |
| 9648 | SPCC777.13_UP | TCATTCTGCAACCAACGCCC |
| 9649 | SPCC777.13_DN | CCGCGCCATCACTTCCATCA |
| 9650 | SPCC777.14_UP | ACCTTGTGTATGGGGGCGGC |
| 9651 | SPCC777.14_DN | CACCAGGAAGAAGAAGGCCAC |
| 9652 | SPCC777.15_UP | ACCTCGCCTCTCGTCTCCA |
| 9653 | SPCC777.15_DN | CCGCCCCTTCCTGCCTTCAC |
| 9654 | SPCC777.17c_UP | GACTGGACTAGCCGGGCTTGC |
| 9655 | SPCC777.17c_DN | GTGGTCGTCGGGAGTTGGGT |
| 9656 | SPCC780.02_DN | ATTCGTAGCCTGCGTTGCCCC |
| 9657 | SPCC790.02_DN | GCGCGGCCGAAACTCTATGA |
| 9658 | SPCC790.03_UP | AAGGTTCGCCGGTGTTTCGG |
| 9659 | SPCC790.03_DN | GAGGCGGCGGTCGGATAAAC |
| 9660 | SPCC794.01c_UP | AAAACACCCAGATCGCCCA |
| 9661 | SPCC794.01c_DN | GCAGGGTACAGCCGGGATTG |
| 9662 | SPCC794.02_UP | TAGAAGGGCCGCGGATTGGTA |
| 9663 | SPCC794.02_DN | GCTCCCCGCCTCACCTTACT |
| 9664 | SPCC794.03_UP | CTTGGTTCGTCCCGCTTCGG |
| 9665 | SPCC794.03_DN | CATCCCAGTTTCCCGCCCAA |
| 9666 | SPCC794.04c_UP | CCATAATCCAGCCGCAACGC |
| 9667 | SPCC794.04c_DN | ACCTTGCTGGGAAAAGCCGA |
| 9668 | SPCC794.06_UP | GTGTTGCGGCGTGGTTTTGC |
| 9669 | SPCC794.06_DN | GCAACGACGGAGGGGGAGTGC |
| 9670 | SPCC794.07_UP | CGGGGTAAATCGGTTGCGGC |
| 9671 | SPCC794.07_DN | CAGGCTCCAGCAACTGACCA |
| 9672 | SPCC794.08_UP | CGGGCAGAACACATCCACCC |
| 9673 | SPCC794.08_DN | CTTTGGAGAGTTGCGCGCGG |
| 9674 | SPCC794.09c_UP | TCTCAGCCGCCCGATAAACC |
| 9675 | SPCC794.09c_DN | GAAGCGGCAGACGAAACCC |
| 9676 | SPCC794.10_UP | GGGGCGTAGGGATCGGGTCT |
| 9677 | SPCC794.10_DN | CGGTGGGTGCGCTCTTTTTT |
| 9678 | SPCC794.11c_UP | GGACCAACCCGATGCGAACA |
| 9679 | SPCC794.11c_DN | CAACATGGGGTCGCTTCCTG |
| 9680 | SPCC794.12c_UP | AAGCGGGGCACTGGGTAACA |
| 9681 | SPCC794.12c_DN | GCCGTGTCCCCGTTCGTAAA |
| 9682 | SPCC825.01_UP | GAGATGCATCGCGAGACCGCG |
| 9683 | SPCC825.01_DN | GGTACCATGCTTCGGGGCCA |
| 9684 | SPCC825.02_UP | TGCAGTTATTCAGGGGCCGC |
| 9685 | SPCC825.02_DN | CGCCCTCCTACGTTGCACCG |
| 9686 | SPCC825.04c_UP | CCCCAAGCCGTCATCGAAC |
| 9687 | SPCC825.04c_DN | TACCAGGGGGAGCCCGTCTA |
| 9688 | SPCC825.05c_UP | CCTTGCCTTGCGTTCCCTTG |
| 9689 | SPCC825.05c_DN | ACAGGTGCTATGCAGGGGCC |
| 9690 | SPCC830.03_UP | GTCTGGTTCGCCTACCTTGC |
| 9691 | SPCC830.03_DN | AGCCTCGCCGTTTTTACCCC |
| 9692 | SPCC830.04c_UP | TGGGGGAAGTCACAGCCGTCG |
| 9693 | SPCC830.04c_DN | GCCCAGCACTTTCAACCGCG |
| 9694 | SPCC830.05c_UP | GGTCACTCAATCCCGCACGA |
| 9695 | SPCC830.05c_DN | CGGAAGAACATGCGCAAGAAA |
| 9696 | SPCC830.06_UP | CGGTAGGGCGTCAAAACGGT |
| 9697 | SPCC830.06_DN | ACCCGCCAGTCCGCGATAGA |
| 9698 | SPCC830.07c_UP | CCGACAACCAAACCAGCCCC |
| 9699 | SPCC830.07c_DN | TGACCCTCCCGCACAGCGAA |
| 9700 | SPCC830.08c_UP | GCGCCGTCCAAACTCCAAAC |
| 9701 | SPCC830.08c_DN | CATTCTTTTTGGGCCCGCAG |
| 9702 | SPCC830.09c_UP | AAGAGGCGTGCGGGAAAGG |
| 9703 | SPCC830.09c_DN | TCGCCAACCACAGATTCCA |
| 9704 | SPCC830.10_UP | CGCTCGCCCCTTTGTGTCTC |
| 9705 | SPCC830.10_DN | AGAACAGGGGATGCGGAGGG |
| 9706 | SPCC830.11c_UP | AACACGTCCCCTCCCCATCC |
| 9707 | SPCC830.11c_DN | CAGGTACGCGCAGGAATGGC |
| 9708 | SPCC895.03c_UP | AAGTCTGCGGGGGGAATGGA |
| 9709 | SPCC895.03c_DN | AAGCCCAACCCCGCGATGTA |
| 9710 | SPCC895.04c_UP | TCGCCAGCAAGGACAAGAGC |
| 9711 | SPCC895.04c_DN | CTGAGGGGCATGTCGCTGTG |
| 9712 | SPCC895.05_UP | CGGTGGACGAGTGGCGAAGC |
| 9713 | SPCC895.05_DN | TCGTGTGGCTCGTCGTGAAA |
| 9714 | SPCC895.06_UP | GGGAAATAAGGCGACGACCAG |
| 9715 | SPCC895.06_DN | CTCCCCCGATTCTGCCTTGC |
| 9716 | SPCC895.07_UP | TGGAGGCTGTGGGACACTTT |
| 9717 | SPCC895.07_DN | TACCCGTCCGCTTCCTCGGT |
| 9718 | SPCC895.08c_UP | TACCGCAAGCCTCCACGTCC |
| 9719 | SPCC895.08c_DN | AGCAAGCACGGGGCAAGGAC |
| 9720 | SPCC895.09c_UP | AATGCCAACCCGAAAACCCG |
| 9721 | SPCC895.09c_DN | CGGTTCCCACCTCCCTTGAA |
| 9722 | SPCC962.03c_UP | GATCCACAGTTAGGCGGGCT |
| 9723 | SPCC962.03c_DN | AGTACAGCGCGTAGTGTGCC |
| 9724 | SPCC962.04_UP | TGCGCACGTTCTTCCATCCA |
| 9725 | SPCC962.04_DN | TGGCATTTTCTTCGCCGACG |
| 9726 | SPCC962.05_UP | CCCAACAAAAACCACGCGAA |
| 9727 | SPCC962.05_DN | GCGCAGCAAACAGAGCAGGG |
| 9728 | SPCC962.06c_UP | GGGGACAAAAGCGCGACGA |
| 9729 | SPCC962.06c_DN | GAGGTTGTTTCCGCAGGCG |
| 9730 | SPCC965.04c_UP | ACATCCGCCTATTCCCCCGC |
| 9731 | SPCC965.04c_DN | TGTCCTTGCCCCGACCTTTT |
| 9732 | SPCC965.05c_UP | TCGCTCCCATCCCAATCCCC |
| 9733 | SPCC965.05c_DN | GCCATTCGGGGGGGGTACTC |
| 9734 | SPCC965.06_UP | CCACCTCCTCGTTGCTCCGC |
| 9735 | SPCC965.06_DN | CGTGCAATCCTACCCCCGGA |
| 9736 | SPCC965.07c_UP | CGCTGTGCTCGTGGCCTGTT |
| 9737 | SPCC965.07c_DN | TTGAGGCTTGTTCGGGGGTG |
| 9738 | SPCC965.08c_UP | TATGACACCCTGAACCGGCC |
| 9739 | SPCC965.08c_DN | ATGATCGCGCGCCCTCCTTT |
| 9740 | SPCC965.09_UP | TCCCGAAACAAGCCTCCCAC |
| 9741 | SPCC965.09_DN | CTGCGCCCTCCTCATTGTTG |
| 9742 | SPCC965.10_UP | CGACACGTGTTCTCAAGCCG |
| 9743 | SPCC965.10_DN | AGTTGGACGCCTAAGCGAC |
| 9744 | SPCC965.11c_UP | GGTGTAGGCGGGGGTAAGGC |
| 9745 | SPCC965.11c_DN | TCGTGGGGCATTTCAGCATC |
| 9746 | SPCC965.12_UP | GGCCTGCCCCCCATTGCCTA |
| 9747 | SPCC965.12_DN | AGCGAGGTGGAGAGTGGGGG |
| 9748 | SPCC965.13_UP | GGCTGAGAGGGGCGAGACGG |
| 9749 | SPCC965.13_DN | CATCAGCCCGCCCACCATAG |
| 9750 | SPCC965.14_UP | AACATTAACCCGCCTCCCGC |
| 9751 | SPCC965.14_DN | GCAAGGAAGGGCGTCGGATC |
| 9752 | SPCC970.01_UP | CAGGGGGATGGGTTTAGGCG |
| 9753 | SPCC970.01_DN | TATTGAGCTTCGGCGCGGAC |
| 9754 | SPCC970.02_UP | TGGGATCGCAACAAAACCGG |
| 9755 | SPCC970.02_DN | CGGGCGGGGGGTTCAAATATC |
| 9756 | SPCC970.03_UP | TCATTACCCCTCACGGCGCG |
| 9757 | SPCC970.03_DN | TGAAGCATCGTCCCAACCGG |
| 9758 | SPCC970.04c_UP | GTGCCCTTGCGCTTGATTGA |
| 9759 | SPCC970.04c_DN | TGGACCGCACCCCTCTACGC |
| 9760 | SPCC970.05_UP | TTTGGTCCCTGGCCTCTGC |
| 9761 | SPCC970.05_DN | CGGGCGCTTCTAGCTTCGAT |
| 9762 | SPCC970.06_UP | CCCCAGGTCCAGAAACAGGC |
| 9763 | SPCC970.06_DN | ATTGGCTTTTTGGCGGCTGC |
| 9764 | SPCC970.07c_UP | AACGGGGAGGCGGGGTATTA |
| 9765 | SPCC970.07c_DN | GGTCGTGCTTCGTCGTCTCGG |
| 9766 | SPCC970.08_UP | TGCGTGCGATGGTGCTTTCC |
| 9767 | SPCC970.08_DN | ATGGCGGACTCTTGGCGTTG |
| 9768 | SPCC970.09_UP | CCTTTGAGTTGTGTGCGCCG |
| 9769 | SPCC970.09_DN | GCTTGCTCGGTCGGGGCTTA |
| 9770 | SPCC970.10c_UP | CCTGTAATCGGACTGCCGTGT |
| 9771 | SPCC970.10c_DN | ATGAACGGGCCCCTACAGGA |
| 9772 | SPCC970.11c_UP | AGGAGGTGAGCGCGGATTGT |
| 9773 | SPCC970.11c_DN | CCTTCTCCCTTGGCGCCTCG |
| 9774 | SPCC970.12_UP | GCATTCTGTCCGCACTCCCG |
| 9775 | SPCC970.12_DN | TCTGCATTTGGGGACGCCTT |
| 9776 | SPCP1E11.02_UP | CGTCCTGTACCCCCTACTGC |
| 9777 | SPCP1E11.02_DN | CTGTGGTCGTAGTCGGGGCG |
| 9778 | SPCP1E11.03_UP | TCAATGCCCTTCCCAATTAC |
| 9779 | SPCP1E11.03_DN | TACAAAGGGCGGGAACGGGG |
| 9780 | SPCP1E11.04c_UP | CGTCGTTGCCGGGATCTCAG |
| 9781 | SPCP1E11.04c_DN | CCGAGCCCAAGACGGTTCCA |
| 9782 | SPCP1E11.05c_UP | GCTGCTGGGGTGTGGTCGTT |
| 9783 | SPCP1E11.05c_DN | GGGATCAGCGGGGAGGAATT |
| 9784 | SPCP1E11.06_UP | CGTGAAGGGCGAGTAGGCGT |
| 9785 | SPCP1E11.06_DN | AGCACGCAACAGACGGCACT |
| 9786 | SPCP1E11.07c_UP | CGGGGTGGCGGGTAGTATGT |
| 9787 | SPCP1E11.07c_DN | ATAGGCCAACACGGGGGG |
| 9788 | SPCP1E11.08_UP | CTCGGCCACCTCAAACCCCC |
| 9789 | SPCP1E11.08_DN | TGTAGGTGCGCGCTTCGGGT |
| 9790 | SPCP1E11.09c_UP | CTGCCTCGATTGCGCGTGCC |
| 9791 | SPCP1E11.09c_DN | AAGTACGGCCCCACCTCGCC |
| 9792 | SPCP1E11.10_UP | GCTGCATGCCGGCACTATCGG |

FIG.55

| Sequence number | Name | Base sequence | Sequence number | Name | Base sequence |
|---|---|---|---|---|---|
| 9793 | SPCP1E11.10_DN | GAACAGGCCATGACGCGAAA | 9895 | SPCC576.19c_DN | AAGGCGCATGACGGTCCCTA |
| 9794 | SPCP1E11.11_UP | CTGATTTCCGCGTGCTTGCC | 9896 | SPAC3G5.16c_UP | ATGTGCACTCGCAACCGCCT |
| 9795 | SPCP1E11.11_DN | TCGGCAGGAACAGCAGCACT | 9897 | SPAC3G5.16c_DN | GTTCCGGGGCTCGAATACT |
| 9796 | SPCP20C8.01c_UP | CGCTCACACGCAACCAAGGG | 9898 | SPAC1F3.04c_UP | ACGGCTAGCGCTTACTCCAC |
| 9797 | SPCP20C8.01c_DN | CCGCCGCACCCGTTATATCA | 9899 | SPAC1F3.04c_DN | ATGGTGCCCGAGGGAGCATT |
| 9798 | SPCP20C8.02c_UP | AGCAGAGCGAGTGACGGCAG | 9900 | SPAC23D3.14c_UP | GGTCGAGAGGCGCTAAGTGA |
| 9799 | SPCP20C8.02c_DN | AATTCATCCTAGGGGGCGGC | 9901 | SPAC23D3.14c_DN | TACCACCCGTGACGGTCTCT |
| 9800 | SPCP25A2.02c_UP | GACCGTAGCGCTTTTGCGGG | 9902 | SPAC2F7.16c_UP | GGCAGCGTACGACGTCTCAA |
| 9801 | SPCP25A2.02c_DN | CTTGGCTGCATGCGGTTGGA | 9903 | SPAC2F7.16c_DN | AACGAGAGTGCCCGGAGTGT |
| 9802 | SPCP25A2.03_UP | AGTATTGGGGTTGGCGCTCA | 9904 | SPAC4D7.08c_UP | TGCTCGATCCGGTAGGCAGA |
| 9803 | SPCP25A2.03_DN | CCAAGCGGAGCGAGGGTATC | 9905 | SPAC4D7.08c_DN | AACGTCTGCCGACAGGAGCA |
| 9804 | SPCP31B10.02_UP | GAGCGGAACAAAGGGCGTGG | 9906 | SPAC6B8.08_UP | TTCGTACCGACCGGGCAATC |
| 9805 | SPCP31B10.02_DN | TTGCGGCCCTTCCTCTTGGT | 9907 | SPAC6B8.08_DN | AGGCGGTTCATGTCAGGGTG |
| 9806 | SPCP31B10.03c_UP | AGATCAAACCCCCGCGAAC | 9908 | SPAC9.09_UP | AGCGCTTACCCGTCAGGAAA |
| 9807 | SPCP31B10.03c_DN | TGAAACGCAGCTCGCCAGGA | 9909 | SPAC9.09_DN | GCGGTGCACATAGGACAACC |
| 9808 | SPCP31B10.04_UP | GAGCGGCGTTGTCTGTGTGG | 9910 | SPAP7G5.06_UP | ACGTCGAGTAACCCGTGCAT |
| 9809 | SPCP31B10.04_DN | TAGCCCCTTCTCTCGCCTGG | 9911 | SPAP7G5.06_DN | AACAGTCTGGCCTGTGGCGA |
| 9810 | SPCP31B10.05_UP | CCTCCAGCTTGCCGTCCTC | 9912 | SPAPB15E9.01c_UP | TTGTCCGTACGCACTCTGGC |
| 9811 | SPCP31B10.05_DN | GGCCGCACCGTCTCAGCCTTC | 9913 | SPAPB15E9.01c_DN | CATCCCACCGTCGGAGACAT |
| 9812 | SPCP31B10.06_UP | GGGTGGGCGACAACGAGAAG | 9914 | SPAPB17E12.13_UP | CGCCAGACTAGGTGTGAGCA |
| 9813 | SPCP31B10.06_DN | GACGCTTTGTTGGGCCCTGT | 9915 | SPAPB17E12.13_DN | AGGATACCGCTGAATGCACG |
| 9814 | SPCP31B10.07_UP | TCAGGTGCCCTGGACCACAT | 9916 | SPAPB18E9.02c_UP | TGACGGTCCTAACCTGCGGA |
| 9815 | SPCP31B10.07_DN | AGCGGGGAAGGGACAAGGAC | 9917 | SPAPB18E9.02c_DN | TATGACCGCAGTCGCCGTGA |
| 9816 | SPCP31B10.08c_UP | AGACCGCTCACGTCGAACCT | 9918 | SPBC119.10_UP | TCGTCCACGCTAGAACCTT |
| 9817 | SPCP31B10.08c_DN | ATTAGGTCCAGCTGCGGTCC | 9919 | SPBC119.10_DN | CGACCTCGCAGGTTACGACA |
| 9818 | SPCPB16A4.02c_UP | TAGGCGCATGCACGAAAAGG | 9920 | SPBC16G5.19_UP | ATACGGTGTCGCTCGGATGC |
| 9819 | SPCPB16A4.02c_DN | ATGCCGGACGTTGGTGAGGA | 9921 | SPBC16G5.19_DN | GGGACTGCCCGTTGCTAGTT |
| 9820 | SPCPB16A4.03c_UP | TCGAACCGGGGATAGCTGCC | 9922 | SPBC1711.02_UP | CTTGGACTGCGGTTCCGCTA |
| 9821 | SPCPB16A4.03c_DN | GGGGAGCTTTGGGGCATGAC | 9923 | SPBC1711.02_DN | TGCACCTGGGTCTCGCGTTA |
| 9822 | SPCPB16A4.04c_UP | GGCTGCGGTGGGTCGTGTAA | 9924 | SPBC17G9.06c_UP | TTTGAGACACCTGGGCTCTC |
| 9823 | SPCPB16A4.04c_DN | GCCCGACCCGCTTTTGTACTC | 9925 | SPBC17G9.06c_DN | ACCGCCTGCACGTATGGCTA |
| 9824 | SPCPB16A4.05c_UP | CCCGGTTGCTTGATCGCTTG | 9926 | SPBC1D7.02c_UP | TTGCACCTACGTGACTGCCT |
| 9825 | SPCPB16A4.05c_DN | CGGGGGCCAGAGGGGTAGAG | 9927 | SPBC1D7.02c_DN | CGTTAGTCGAGGCTCGCAGT |
| 9826 | SPCPB16A4.06c_UP | GGCACGCAACCAACCAGACG | 9928 | SPBC1E8.05_UP | GACTGTGCGCACTGCGGTTA |
| 9827 | SPCPB16A4.06c_DN | TCAAAACGGCCGACAAGAGG | 9929 | SPBC1E8.05_DN | TGCCGCGACCTAACATGAG |
| 9828 | SPCPB1C11.01_UP | GGGCCGGAACGAAAGGTGTT | 9930 | SPBC211.05_UP | GGATATGCGATCGGCCCAGA |
| 9829 | SPCPB1C11.01_DN | AACAGCTATTGGGGTGGCGG | 9931 | SPBC211.05_DN | CCTAAACTCGGGTTCGCCAGT |
| 9830 | SPCPB1C11.02_UP | CCTTCTGAGGACCGCGGATTT | 9932 | SPBC215.15_UP | AGACGCGTAACGGCCGGTCTT |
| 9831 | SPCPB1C11.02_DN | CGCGAACGGGACAACTCTGA | 9933 | SPBC215.15_DN | GCGTCACTACGCGTCAGTCT |
| 9832 | SPCPB1C11.03_UP | CAGGACAGGCCAACACCGA | 9934 | SPBC21D10.06c_UP | AAGAGTCCGTGCCAACGTCT |
| 9833 | SPCPB1C11.03_DN | CAAGGAGAGACGCCCCAACG | 9935 | SPBC21D10.06c_DN | TGTAAGTCGCGACCGGTACG |
| 9834 | SPCPJ732.01_UP | TGTCCGGAAGCTCGTAGGGC | 9936 | SPBC23G7.09_UP | GGACATGACACGCGGACCTA |
| 9835 | SPCPJ732.01_DN | ATGCCGGTTCTCTGGTCCCC | 9937 | SPBC23G7.09_DN | CCGTTCGGGTCTAAGGGCAA |
| 9836 | SPCPJ732.02c_UP | CGCGCTAACGGTAGCCCTTTT | 9938 | SPBC23G7.17c_UP | AACGAGTTCGCGTTAGAACCA |
| 9837 | SPCPJ732.02c_DN | GCTGCTCAGCCCTGTAAGATCG | 9939 | SPBC23G7.17c_DN | TCTTGACGTGGACCCAGTGC |
| 9838 | SPCPJ732.03_UP | CAGGGGCAAAGTGGGCARGG | 9940 | SPBC32F12.15_UP | TTGCACGTGAGTCGGCCTAT |
| 9839 | SPCPJ732.03_DN | TGCGAGGGAAGTTAAGCCGG | 9941 | SPBC32F12.15_DN | ATCACCCGGTGGGCTGTATC |
| 9840 | SPAC23A1.10_UP | ACACCCGTGGACCTCACTTG | 9942 | SPBC365.05c_UP | ACCACTAGACGGGCACATCG |
| 9841 | SPAC23A1.10_DN | ATAGCGGGACTCCGGTGGTA | 9943 | SPBC3G5.05c_DN | ATCGTAGCGTGCCCAAAGGT |
| 9842 | SPAC30D11.05_UP | ACGGGGAGCGGAACCTATCA | 9944 | SPBC3B9.22c_UP | GCTGGTCCCTGAGCGTATCA |
| 9843 | SPAC30D11.05_DN | ATCCAGGGGCGCAATCCAAT | 9945 | SPBC3B9.22c_DN | CGCCCTACTTGCGTCGACAT |
| 9844 | SPBC1A4.08_UP | TATCTTTGGGCGTGGCGAGCG | 9946 | SPBC3D6.16_UP | CCCAGATTACCCCACACGCT |
| 9845 | SPBC1A4.09_DN | GGGGTGCGACGTGTTGGCGTC | 9947 | SPBC3D6.16_DN | GAASGCCACCTGTGACAGCA |
| 9846 | SPBC1289.17_UP | AGTCTGCTCAGGGTACACCGA | 9948 | SPBC3F6.03_UP | TTTTGCCCGGACAGCTCTGG |
| 9847 | SPBC1289.17_DN | TAGGGTCCGACCCTGTGGGAA | 9949 | SPBC3F6.03_DN | CCGGCGCTTAAGGGTGGTAT |
| 9848 | SPAC27E2.08_UP | TCTATGTGGTGCCAGAGCCG | 9950 | SPBC6B5.09_UP | TGTAAGTATGCGGGCCGGTT |
| 9849 | SPAC27E2.08_DN | TCACACGTCAGCAGCGGGTGG | 9951 | SPBC6B5.08_DN | CCGTGTCAGTCCGGTTCAGA |
| 9850 | SPCC285.07c_UP | TCTCGCTCGCACTACGACAC | 9952 | SPBC6B1.12c_UP | TGACGACGCAGTAGGGAACC |
| 9851 | SPCC285.07c_DN | ACGGTCGCGGTCACCAGAAT | 9953 | SPBC6B1.12c_DN | ACTCTCAGGGCACAGTGACC |
| 9852 | SPCC622.21_UP | TGCTGTACGCAGAAGGTCGC | 9954 | SPBC800.14c_UP | TGGCGTCGACACGGAGGTTT |
| 9853 | SPCC622.21_DN | ATCGGTGTTAGGCACTCGCC | 9955 | SPBC800.14c_DN | TGCCCAGTCTAGACCCTGACA |
| 9854 | SPAC1250.07_UP | ATCAGCCCCTCGGTGGTAAC | 9956 | SPBCPT2R1.04c_UP | ATCGTTAGACCCGGCACTGCA |
| 9855 | SPAC1250.07_DN | CGAAGCTGGCGCGATAATGC | 9957 | SPBCPT2R1.04c_DN | GCAGTCGACACTGCGTCCAA |
| 9856 | SPAC1142.09_UP | CGTTTGGTATGAGGCGCCGA | 9958 | SPBP23A10.11c_UP | GGCGTTCTCACACGGATCT |
| 9857 | SPAC1142.09_DN | GCGGAAGCGGTCAAAGAGA | 9959 | SPBP23A10.11c_DN | ACCCGCGCCGGCTTATAGTAG |
| 9858 | SPAC17A2.15_UP | CACATGACGGACGGGATCCA | 9960 | SPBPB21E7.04c_UP | CCGTGGCACTCCCGTGAGATT |
| 9859 | SPAC17A2.15_DN | GTTATGCAGCCGCTCGCCAA | 9961 | SPBPB21E7.04c_DN | TCACTCCGGTAGGGTAGCCA |
| 9860 | SPAC1A6.11_UP | TTGCCACTGGTCAGCACAGT | 9962 | SPBPB21E7.07_UP | TGCTCCCCCAGCGTTCATAA |
| 9861 | SPAC1A6.11_DN | ACTGGTGTACGTCCGAGGGA | 9963 | SPBPB21E7.07_DN | CGCCGTCAATCGTGGGACTT |
| 9862 | SPAC27E2.13_UP | CGTTGTCGTTCCGACCCACT | 9964 | SPBPB8B6.02c_UP | TCTCTAACGTGCACGAGGCG |
| 9863 | SPAC27E2.13_DN | CACCACGCGGACGCTCAAAT | 9965 | SPBPB8B6.02c_DN | GTGTGCCACTACCTAGCCCGT |
| 9864 | SPAC56F8.13_UP | CTCAGGCGAAGGACTCGCCAA | 9966 | SPBPB8B6.03_UP | TGCTCTGGGACTACGCCGAA |
| 9865 | SPAC56F8.13_DN | TGTGGCTCTGCTCCAGACGTG | 9967 | SPBPB8B6.03_DN | TGGGCCAGACAGCTAGGCTT |
| 9866 | SPAC6B12.18_UP | TTGGGTCTCCAGGTCCCTCA | 9968 | SPBPB8B6.06c_UP | TGCGTCTGATCCGGGACTGT |
| 9867 | SPAC6B12.18_DN | AAATCCCGCGAGCTACTGGC | 9969 | SPBPB8B6.06c_DN | CAAAGCAGTCCCGTCCAGCA |
| 9868 | SPAC806.11_UP | GACCGGGCCGTGTAACATCA | 9970 | SPCC1322.13_UP | CCACTAGCCGTGCGCATACT |
| 9869 | SPAC806.11_DN | CTGCGTGTACGTCTCGGGAA | 9971 | SPCC1322.13_DN | GGGTCGGCACTACGTTCTCA |
| 9870 | SPAC8E11.08c_UP | TTACGGACTGGCGCTCAAC | 9972 | SPCC1682.05c_UP | TTCCAGTCCGCTCGTACAGC |
| 9871 | SPAC8E11.08c_DN | CAAGCGCCCTGAGCAGACCAA | 9973 | SPCC1682.05c_DN | TTGCACGGCCATTGTGCTCG |
| 9872 | SPAC9E9.02_UP | GTTCGCGCACAGTTACGGCA | 9974 | SPCC290.04_UP | TGGTCATACCCGGAGACGCA |
| 9873 | SPAC9E9.02_DN | CCTAGCGACGGTGCCCATTA | 9975 | SPCC290.04_DN | GGGAGGTTGCACTCTGGTCA |
| 9874 | SPAPB15E9.02c_UP | TTAGGCTCACACCTGGCTGG | 9976 | SPCC330.05c_UP | ATGGGCGCGCGCAGATTACC |
| 9875 | SPAPB15E9.02c_DN | AGATAGCTCGGAGCGGCCAT | 9977 | SPCC330.05c_DN | AGGGTGCAGTCCTGGCTAGA |
| 9876 | SPAPB18E9.05c_UP | GCTCCCACGCTTATACGGCCT | 9978 | SPCCBB3.10_UP | TGTGCCGTGAGTGCCCAGAA |
| 9877 | SPAPB19E9.05c_DN | TCACGCGTGTCGCTAGTTGC | 9979 | SPCCBB3.10_DN | ATGACATGGGGTACGCGGCA |
| 9878 | SPBC12C2.14c_UP | CTGACGGACCATTGACCGA | 9980 | SPCC569.01c_UP | TAGTCGGCCTTATGGGCACG |
| 9879 | SPBC12C2.14c_DN | CTGTTGCGGCACGTCCATCT | 9981 | SPCC569.01c_DN | GTGACGAACTCGCGGAACGA |
| 9880 | SPBC1347.14c_UP | ACGCCCACGGGCTACACTAT | 9982 | SPCC736.15_UP | GTTACGTCGGAACTGCCCA |
| 9881 | SPBC1347.14c_DN | TGTACGCGGACTTGAGTGGC | 9983 | SPCC736.15_DN | TTTCGGATCCGGAGTGTCG |
| 9882 | SPBC13G1.15c_UP | GATGGCCTACTGCCTCCAGA | 9984 | SPAC23C4.04c_UP | AGGGAGTTCGAGGCCCAAA |
| 9883 | SPBC13G1.15c_DN | TCGGTTCGCCACTAGGCTTC | 9985 | SPAC23C4.04c_DN | TTTCGTAGCGTGACGAGGGC |
| 9884 | SPCC16C4.21_UP | ATACGGTGGTACCGTGCCTG | 9986 | SPAC27E2.12_UP | ATCGCGCCAGGGTGTAGAAC |
| 9885 | SPCC16C4.21_DN | ATCACCGGCAGTGTGGGATG | 9987 | SPAC27E2.12_DN | GCGCAGTCGTAGACGGCAAT |
| 9886 | SPCC198.05_UP | AGACGAATCGCTCGGCAGGT | 9988 | SPAC56F8.07_UP | CAAGTGCAGTGGGACTGCCT |
| 9887 | SPCC198.05_DN | TTCTGCACGTCCGGACGAC | 9989 | SPAC56F8.07_DN | GGGGTTAGCCGTCGGAATGA |
| 9888 | SPCC338.03c_UP | AGCCCATGGGACCTACCTCA | 9990 | SPAPB1A10.16_UP | GGGTATGGTCACCGGTCGAA |
| 9889 | SPCC338.03c_DN | ATGTCGGCCAGGTTAGTCGC | 9991 | SPAPB1A10.16_DN | GATCGATCCAGCACCGTGA |
| 9890 | SPCC417.15_UP | TGTCTTGTCGTAGGTGCCCG | 9992 | SPCC1393.14_UP | GCGCTCTAGTCGGCTCGTAT |
| 9891 | SPCC417.15_DN | ATGACGTCACGGAACTGGCA | 9993 | SPCC1393.14_DN | TCCCGTAACGTGGCAGCACT |
| 9892 | SPCC4F11.05_UP | TTTCAGGACCGACACGGCTC | | | |
| 9893 | SPCC4F11.05_DN | GTTCTGCACGTGCTAGGGGT | | | |
| 9894 | SPCC576.19c_UP | AAATCCCAGGTGCACGTGAA | | | |

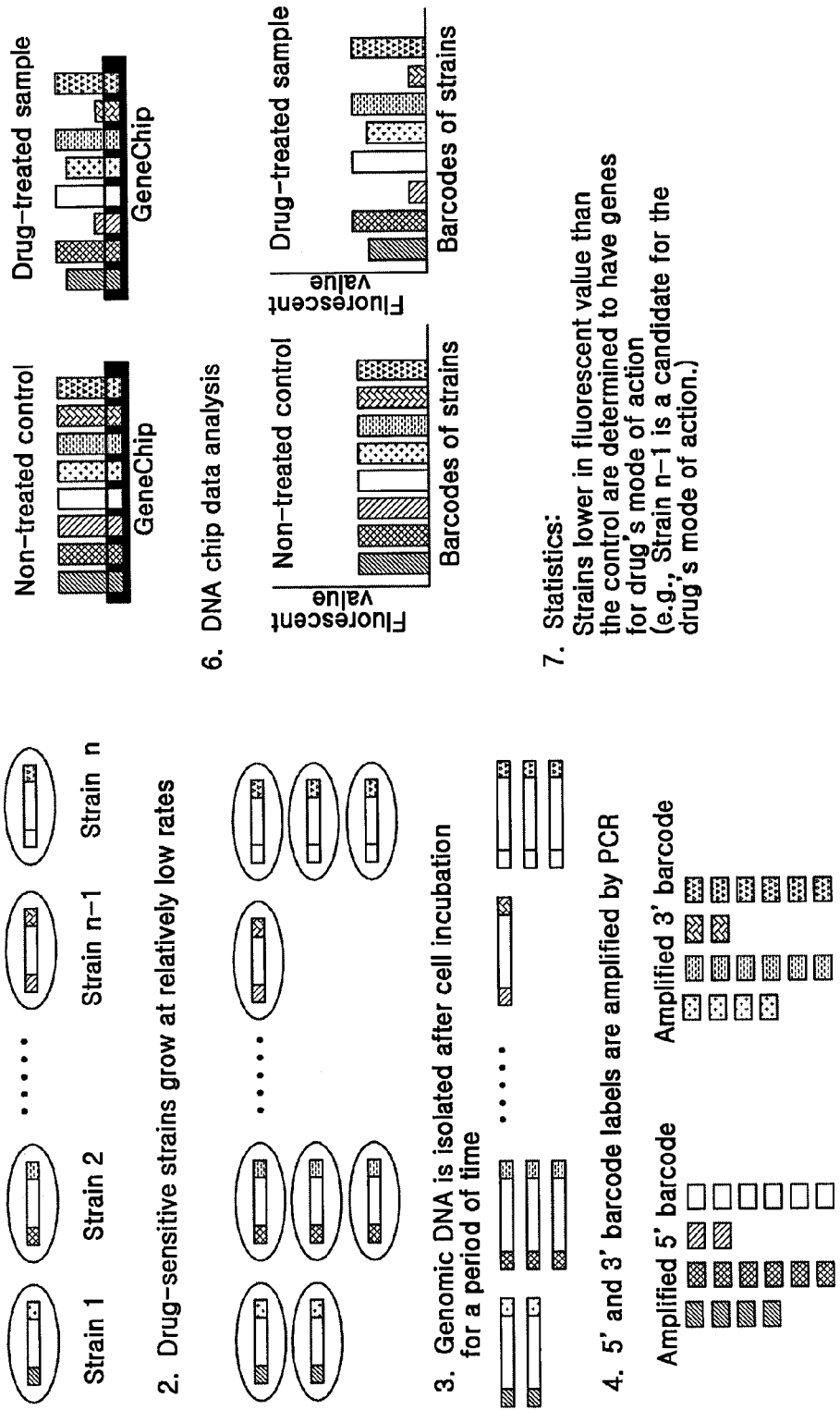
FIG. 56 Process of screening drug's modes of action on the basis of haploinsufficiency FIG. 57 process of constructing a library of gene-targeted deletion mutants
(1) aliquoting of strain mutant mixture
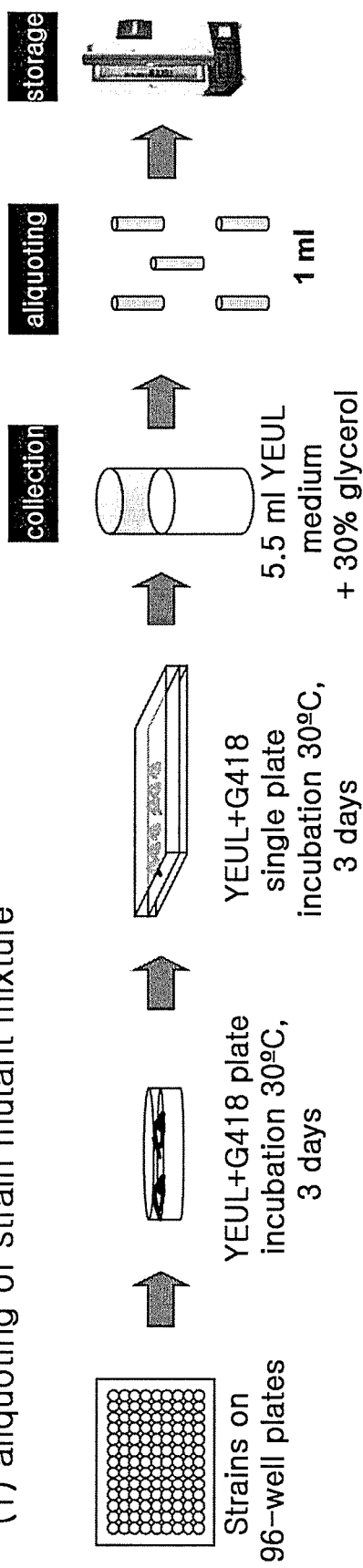
(2) construction of total libraries by pooling aliquots
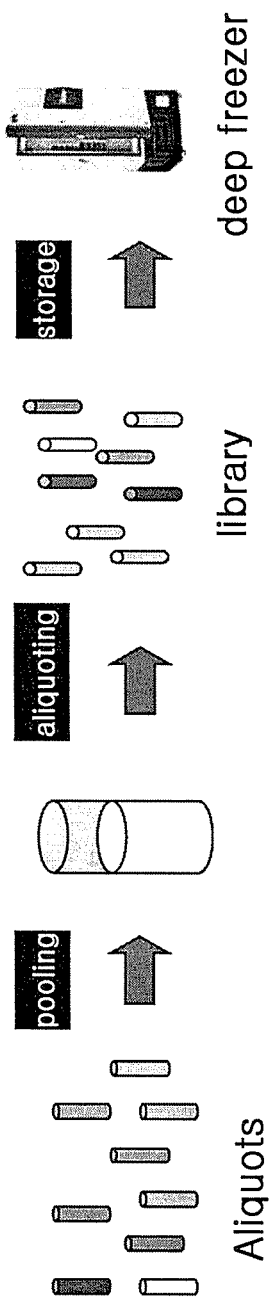

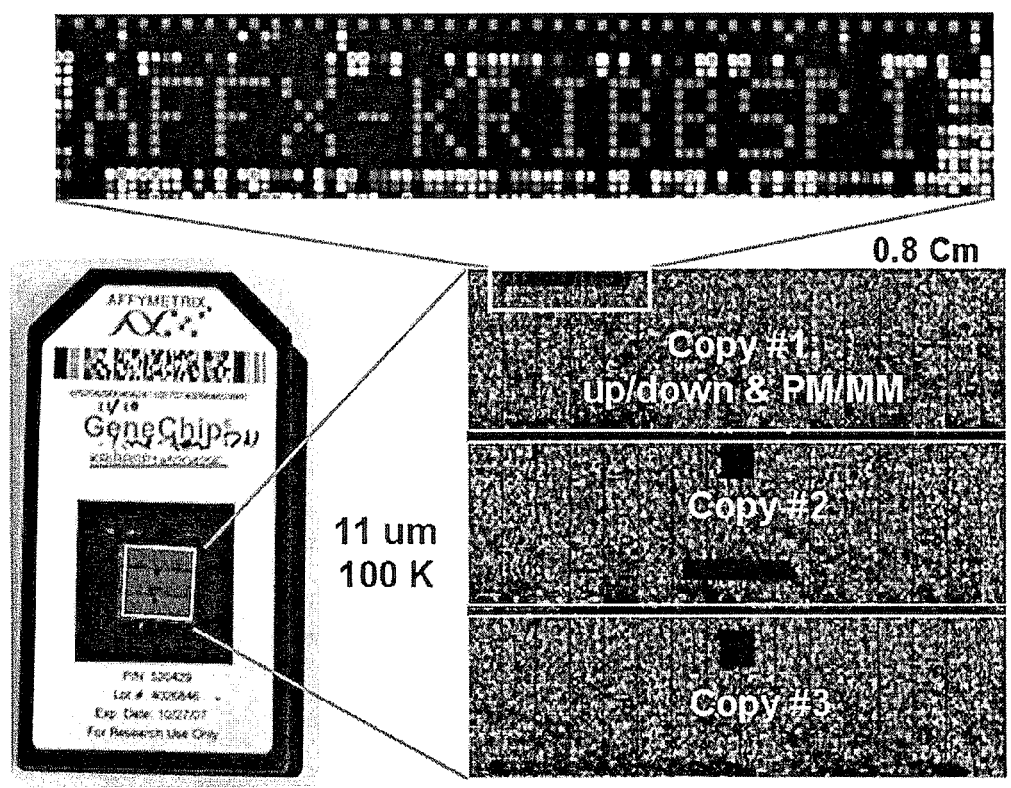
FIG. 58 Made-to-order GeneChip from Affymetrix

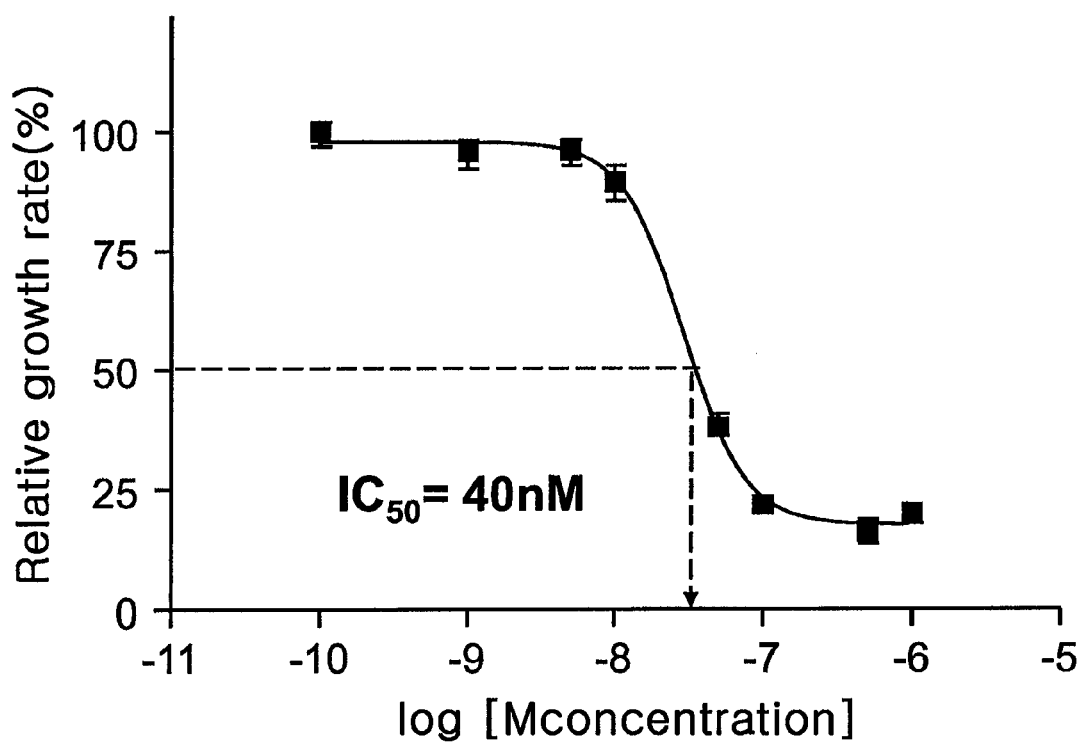
FIG. 59 IC$_{50}$ determination of Terbinafine

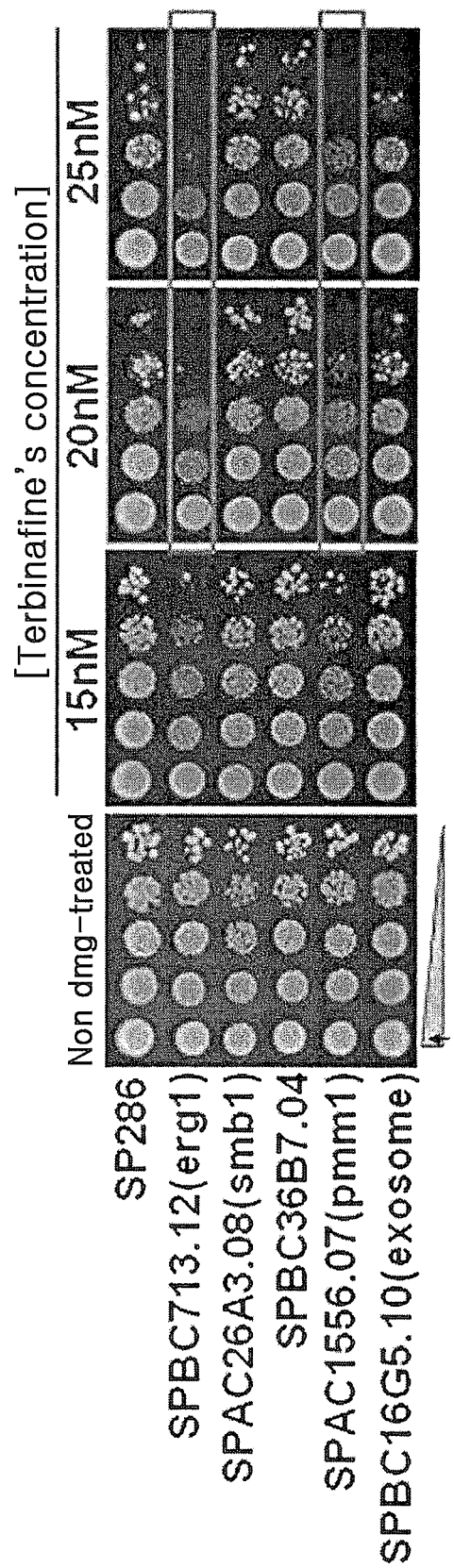
FIG. 60 Confirmation of Terbinafine's Modes of Action erg1 and pmm1

GENOME-WIDE CONSTRUCTION OF *SCHIZOSACCHAROMYCES POMBE* HETEROZYGOUS DELETION MUTANTS CONTAINING GENE-SPECIFIC BARCODES BY THE METHODS OF 4-ROUND SERIAL OR BLOCK PCR, OR TOTAL GENE SYNTHESIS THEREOF

REFERENCE TO SEQUENCE LISTING SUBMITTED ELECTRONICALLY VIA EFS-WEB

The content of the electronically submitted sequence listing (Name: 2472_0070000_updated_sequence_listing_ascii.txt; Size: 1,918,016 bytes; and Date of Creation: Nov. 4, 2013) is incorporated by reference in its entirety.

TECHNICAL FIELD

The present invention relates to a method for systemically preparing gene-targeted heterozygous deletion mutant strains of *Schizosaccharomyces pombe*. More particularly, the present invention relates to a method for the preparation of gene-targeted heterozygous deletion *Schizosaccharomyces pombe* by transforming *Schizosaccharomyces pombe* with a deletion cassette, constructed by four-round serial PCR, block PCR or total gene synthesis, containing a homologous recombination site. Also, the present invention relates to gene-targeted heterozygous deletion *Schizosaccharomyces pombe* mutants prepared by the method, and a library of gene-targeted heterozygous deletion *Schizosaccharomyces pombe* mutants. Further, the present invention is concerned with a method and a kit for screening drug modes of action over the library.

BACKGROUND ART

In 2006, the worldwide drug market was reported to be worth 643 billion dollars and Korean drug products had an 11,472.8 billion won share of the total. The global drug market is expected to increase to 735~745 billion dollars in 2007. It was reported that an average cost of 100~600 million dollars is required to bring a new drug to market, with a developmental period of from 10 to 15 years. In spite of such huge expenses of time and money, the success rate of new drug development is reported to be as low as one in ten thousand. It is accordingly necessary for the successful development of new drugs that highly putative "drug's modes of action" which play critical roles in the occurrence or treatment of diseases, from among a number of possible modes of action, should be defined; this is generally achieved through intelligent bioinformatical tools extracting biological relevance from complex experimental data. Thereby, it is very important to systemically screen specific modes of action directly involved in lots of diseases.

As such, screening technologies are useful in identifying the targets against which drugs exert their therapeutic effects, thus greatly contributing to reducing the time period required for drug development. Also, screening technologies allow the identification of the modes of action which are associated with side effects of the drug. Therefore, there is an imperative need for a novel method for screening a drug's modes of action.

*Schizosaccharomyces pombe*, a fission yeast useful in the preferable embodiment of the present invention, does not have an evolutionarily high correlation with the budding yeast *Saccharomyces cerevisiae* although both belong to ascomycetes. *S. pombe* (Wood V. et al., Nature. 45:871-880, 2002) marked the sixth model eukaryotic organism whose genome has been fully sequenced since *S. cerevisiae* (Goffeau A. et al., Science, 274:546-567, 1996). According to the analysis, *S. pombe* has an effective genomic structure which has the lowest functional repetition of genes among the eukaryotic cells whose genomes have been determined thus far. It was also reported that *S. pombe* contains 4,824 protein-coding genes, which is the smallest number yet identified for a eukaryote, but some 43% of the genes contain introns. Also, *S. pombe* is found to have highly conserved genes important for eukaryotic cell organization including those required for cell-cycle control, proteolysis, protein phosphorylation and RNA splicing. Further, 31% of the genes of *S. pombe* were identified to differ from that of *S. cerevisiae* and to rather share homology with humans. Thus, the comparison of genetic functions between *S. pombe* and *S. cerevisiae* is emerging as an effective methodology to study the functions of human genes.

The term "gene targeting", as used herein to transform yeast strains in the screening of a drug's modes of action, is intended to refer to a genetic technique that uses homologous recombination to change an endogenous gene such as by destroying a gene (knock-out) or by introducing a gene. A transgenic mouse which has had a gene implicated in a specific disease removed therefrom or introduced thereinto has its pathology observed, thus allowing the knock-out gene to be functionally identified.

Since the creation of a transgenic mouse in 1989, gene targeting has made great technical advances. For example, target genes can be introduced at specific developmental stages or into already grown adults. Also, it is possible to design a mutant gene which is expressed at a specific time during development. Martin J. Evans, Oliver Smithies and Mario R. Capecchi were declared laureates of the 2007 Nobel Prize in Physiology and Medicine for their work on gene targeting.

PCR (polymerase chain reaction) is a molecular biological technique for replicating and amplifying DNA (U.S. Pat. Nos. 4,683,195, 4,683,202, and 4,800,159; European Pat. Nos. 0200362, 0201184 and 0229701; Methods in Enzymology, Volume 155, 1987, pp. 335-350, Murakawa et al., DNA 7; 287-295 (1988)). This technique consists typically of from 30 to 40 cycles of denaturation, annealing and extension, and allows a gene segment of interest to be selectively amplified even from trace amounts in the DNA pools. Now variations on the basic PCR technique have been developed, including multiplex-PCR, nested PCR, quantitative PCR, real-time PCR, reverse transcription (RT-PCR), touchdown PCR, etc.

Real-time PCR is an established tool for DNA quantification that measures the accumulation of DNA product after each round of PCR amplification, based on the detection of a fluorescent signal produced proportionally during amplification of a PCR product, because a fluorescent probe is used together with primers. Real-time PCR can obtain PCR results rapidly and conveniently because it does not need electrophoretic determination. Also, real-time PCR enjoys the advantage of a low risk of contamination. For these reasons, real-time PCR enjoys widespread use as a substitute for typical PCR.

Transformation is the genetic alteration of a cell resulting from the uptake, genomic incorporation, and expression of foreign DNA. In practice, the foreign DNA is labeled with a selectable marker to easily select the cells to which the foreign DNA has been successfully introduced. Typical examples of the selectable markers include ampicillin-, tetracycline- and kanamycin-resistance genes. After transformation, culturing in the presence of related antibiotics allows the selection of successfully transformed bacteria. In the present invention, a specific gene is knocked out in the fission yeast by transformation with the introduction of an antibiotic-resistance gene into the corresponding homologous recombination site.

Gene synthesis is a well-known technique on which about 200 articles have published since the development of oligo-ligation based on PCR in the early 1990s (Edge et al., Nature. 292:756-62, Rouillard et al., NAR. 32:176-80, Smith et al., NAR. 10:4467-82, Dillon et al., Biotechniques. 9:298-300, Ciccarelli et al., Nucleic Acid Research. 21:6007-13, Prodromou et al., Protein Engineering. 5:827-29, Stemmer et al., Gene. 164:49-53, Lin et al., Gene. 288:85-94, Venter et al., Proceedings National Academy of Science. 100:15440-45). In principle, oligonucleotides from 20 bp to 60 bp long are annealed and ligated to each other to give a double-stranded DNA fragment which is then used as a template for the amplification of a desired DNA through PCR. The DNA fragment which can be obtained by gene synthesis is generally shorter than 1,000 bp. For a longer gene, the obtained DNA fragments less than 1000 bp are ligated by PCR. In 2003, Dr. Craig Venter succeeded in building the entire 5,386-bp genome of ΦX174 bacteriophage (phiX174 bacteriophage) in such a manner.

With regard to the screening of a drug's mode of action, most widely used are in vitro methods. For example, a mixture of cellular proteins are passed through an affinity column with a drug attached on a resin, and the proteins thus bound to the drug are purified and analyzed by MALDI-TOF (Schreiber et al., Bioorg. Med. Chem. 6:1127-1152). An alternative is to pass a human protein-phage library in which human proteins are expressed on the membrane through an affinity column containing drug-attached resin, followed by selection and analysis of phages bound to the drug to infer the target proteins of the drug (Sche et al., Chem. Biol. 6:707-716).

Recently, attempts have been made on an in vivo screening method which is quite different from the above two methods (Lum et al Cell. 116:121-37). This method, although disadvantageous in that it screens yeast proteins in contrast to the in vitro methods of screening human proteins, has the advantage of being rapid (100 drugs/week), convenient and having a high success rate. In 2004, Drs. Shoemaker and Lum's research team at Merck screened modes of action against 80 pre-existing drugs with an increase in success rate of from 25% to 70%. The screening strategy, referred to as drug-induced haploinsufficiency, is based on the fact that lowering the gene dosage of a drug target increases the susceptibility to the drug. In most cases, one allele is sufficient to permit the cell to function normally, but when the normal phenotype requires the protein product of both alleles, and restitution of 50% of the gene function results in an abnormal phenotype, this is referred to as haploinsufficiency. It was reported that 180 genes, corresponding to 3% of about 6,000 genes, of budding yeast, were implicated in haploinsufficiency such that the mutants grew poorly even in sufficient nutrient media compared to the wild-type (Deutschbauer et al., Genetics. 169:1915-25). This haploinsufficiency is a basis for screening a drug's modes of action in heterozygous mutant yeast strains. For example, assuming that a drug 'a' targets a protein 'A', treatment with the drug 'a' at a dose of $IC_{50}$, a concentration to inhibit the protein 'A' by half, leads to 100% inhibition (knock-down) of the protein 'A' in the gene-targeted heterozygous strain. Accordingly, the drug-treated strain grows at a lower rate than does the non-treated strain. In accordance with the present invention, a method for screening a drug's modes of action on the basis of haploinsufficiency is provided.

Success in constructing gene targeted strains is dependent on the properties of the strains because it is determined by homologous recombination efficiency which differs from one strain to another. However, the homologous recombination efficiency in the same strain is proportional to the length of genomic homologous sites. Thus, a longer DNA fragment corresponding to a genomic homologous site permits the construction of a gene-targeted strain at a more efficient rate. The trials summarized in Table 1 below have been performed on budding yeast, but there are no precedents on fission yeast at such a high success rate (Palaniyandi et al., Nucl Acid Res. 3:2799-2800; Michael et al., Gene. 158:113-17; Kaur et al., Nucl Acid Res. 25:1080-81).

TABLE 1

| Construction of Deletion Cassettes | | Yeasts | Homologous Length (bp) | Success rate(%) |
|---|---|---|---|---|
| PCR with gene-specific Oligo | Serial PCR | Budding | 45~60 | 81 |
| | Single Oligo | Budding | 38~50 | 10 |
| | Single Oligo | Fission | 40 | 1~3 |

Typically, a gene specific linker-mediated PCR method has been used to lengthen homologous recombination sites for use in the construction of gene-targeted fission yeast strains. Using this method, Giaever et al. constructed about 6000 deletion cassettes of the total genome of the budding yeast such that each cassette was flanked by two 40-60 bp homologous regions of yeast DNA sequence (Giaever et al., Nature Genetics 14:450-56; Wach et al., Yeast 10:1793-1808). In the case of the budding yeast, 45~60 bp genomic homologous regions at both termini of each cassette guaranteed a success rate of as high as 81% in the genome-wide construction of mutant strains (Table 1). In fission yeast however, even when the homologous length is extended to 40 bp, the success rate is increased to at most 1~3%. Such a low success rate for the fission yeast indicates that strain preparation is very difficult due to the inferiority of the fission yeast in homologous recombination rate to that of the budding yeast. In full consideration of this background, the present invention provides a method for constructing fission yeast mutants at high efficiency through homologous recombination.

DISCLOSURE

Technical Problem

Reportedly, it is technically more difficult to construct gene-targeted mutants from fission yeasts than from budding yeasts (Decottignies et al., Genome Research. 13:399-406). In the present invention, a deletion cassette is constructed by flanking a selectable marker gene with a pair of 20-mer gene-specific barcodes and assigning a pair of homologous recombination regions 250~350 bp in length to the sides of respective barcodes, and is transformed into the fission yeast to make gene-targeted heterozygous deletion mutants of the fission yeast. Based on a library of the heterozygous deletion mutants, a Genechip allows the high throughput screening of a drug's modes of action.

Technical Solution

It is therefore an object of the present invention to provide a method for preparing a gene-targeted, heterozygous deletion mutant strain of *Schizosaccharomyces pombe*, using a gene targeting deletion cassette comprising a selectable marker gene, barcode base sequences for microarrays, and homologous recombination regions.

It is another object of the present invention to provide a gene-targeted, heterozygous deletion mutant strain of *Schizosaccharomyces pombe*, prepared using the method.

It is a further object of the present invention to provide a library of gene-targeted, heterozygous deletion mutant strains of *Schizosaccharomyces pombe*, prepared using the method.

It is still a further object of the present invention to provide a method of screening a drug's modes of action on the basis of the library of gene-targeted, heterozygous deletion mutant strain of *Schizosaccharomyces pombe*.

It is still another object of the present invention to provide a kit for screening novel drugs, comprising the library of gene-targeted, heterozygous deletion mutant strain of *Schizosaccharomyces pombe*.

Advantageous Effects

A system of preparing gene-targeted, heterozygous deletion mutants of *Schizosaccharomyces pombe* was first established in the world by the present inventors. Also, the present invention increased a success rate in constructing a strain of fission yeast, which is generally recognized as being lower than that for budding yeast, to 95%~99%, which is similar to the success rate for budding yeast. Out of approximately 6,000 genes of *Saccharomyces cerevisiae*, only 5,700 genes (95%) were successfully used in constructing heterozygous deletion mutants of the budding yeast (refer to "*Saccharomyces* Genome Deletion Project" disclosed in the Website sequence.stanford.edu/group/yeast_deletion_project/not_made.html).

In the present invention, 4,945 gene-targeted, heterozygous deletion mutants of *Schizosaccharomyces pombe* which corresponds to 99% of the approximately 5,000 genes (4,989~5,014 genes estimated) obtained, on Jun. 20, 2007, from the public fission yeast database at the Wellcome Trust Sanger Institute genedb.org/genedb/pombe/index.jsp) were successfully constructed.

The 55 genes excluded from the construction, which corresponds to 1% of the total genes and consists of 18 wtf genes, 11 Tf2 genes and 26 dubious genes, are theoretically impossible to use in constructing gene-targeted deletion mutants. A library of the heterozygous mutant strains prepared according to the present invention can be also applied to the system of screening a drug's modes of action on a gene level, thus effectively developing novel drugs.

DESCRIPTION OF DRAWINGS

FIG. 1 is a schematic view showing a structure of a typical deletion cassette for gene targeting, FIG. 2 shows a process of constructing a Kan$^r$-barcode module for use in a deletion cassette, FIG. 3 shows a process of constructing a deletion cassette through four-round serial PCR, FIG. 4 shows a process of constructing a deletion cassette through block PCR, FIG. 5 shows a process of constructing a deletion cassette through gene synthesis, FIG. 6 shows the identification of a desired mutant strain by colony PCR, FIGS. 7 to 55 show base sequences of gene-specific barcodes to be inserted into deletion cassettes for the construction of gene-targeted mutant strains FIG. 56 schematically shows a process of screening a drug's modes of action using GeneChip on the basis of haploinsufficiency, FIG. 57 is a process of preparing a library of gene-targeted mutants for screening a drug's modes of action by use of GeneChip, FIG. 58 shows an order-made GeneChip from Affymetrix, FIG. 59 shows the measurement of the antifungal agent terbinafine for $IC_{50}$ applied to the screening of a drug's modes of action on Genechip, and FIG. 60 shows the reconfirmation of the Genechip-based terbinafine's modes of action on plates.

BEST MODE

In the present invention, four-round serial PCR, block PCR or gene synthesis is employed to amplify deletion cassette modules with which transformed gene-targeted mutants are then constructed. In turn, the mutants are used to construct a library of DNA of which advantage is taken to search for a drug's modes of action.

In an embodiment of the present invention, provided is a method for constructing gene-targeted heterozygous deletion mutants of fission yeast using a deletion cassette which comprises (a) a selectable marker, (2) a pair of gene-specific barcode base sequences, positioned respectively at both flanks of the selectable marker gene, for a microarray, and (3) a pair of at least 150 bp homologous recombination regions, respectively assigned to sides of the barcode base sequences at positions upstream and downstream of the selectable marker gene. A detailed description will be given of each component, below.

Selectable Marker

A selectable marker is used to discriminate successfully transformed yeasts from unsuccessful ones. Examples of the selectable marker useful in the present invention include auxotrophic markers, neomycin resistance ($neo^R$), kanamycin resistance ($kan^R$), hygromycin resistance (hyg), histidinol dehydrogenase (hisD), guanine phosphoribosyltransferase (gpt), tetracycline ($tet^R$), hypoxanthine phosphoribosyltransferase (hprt), ura3, ble and sacB, with preference for kanMX, which is derived from kanamycin resistance gene. The deletion cassette comprising a selectable marker may be integrated into the genome by homologous recombination.

An autographic marker that requires a specific amino acid or nucleic acid for survival, such as ura4, leu1, his3, is currently used for targeted gene integration and disruption in fission yeasts. However, a strain with one or more auxotrophic mutations is requisite for the use of such a marker. Also, a gene conversion may occur in the auxotroph due to the introduction of DNA. Further, auxototrophic mutation itself; together with other mutations, may result in phenotypes which are difficult even to guess, such as somosensitivity, nitrogen-starvation regulated cellular differentiation, sporulation, pseudohyphae, etc. In addition, many auxotrophic mutations may make it difficult for the yeast to grow in a typical medium.

In order to overcome these limitations of auxotrophic markers, the Philippsen group developed the KanMX module as a dominant drug resistance marker. This marker was used for the deletion project of *Saccharomyces cerevisiae*. Resistant to Geneticin® (G418), the kanMX module was designed to serve as a selectable marker. Over auxotrophic markers, the G418 marker has the advantage of giving a high rate of deletion even upon the use of PCR-DNA fragments. Now, additional dominant drug resistance markers have been developed, including those resistant to hygromycin B, nourseothricin, and bialaphos/phosphinothricin.

Used in a preferred embodiment of the present invention is the selection maker KanMX4 which is 810 bp in length and contains Kan transposon Tn903 ORF from *E. coli*. With aminoglycoside phosphotransferase activity, KanMX4 is reported to inhibit kanamycin or its derivative G418 (Lang-Hinrichs et al., Current Genetics. 18:511-6, Oka et al., J. Mol. Biol. 147:217-26). This kanMX module, one of the dominant drug resistance markers, contains the known kan$^r$ open reading-frame (ORF) of the *E. coli* transposon Tn903 fused to transcriptional and translational control sequences of the TEF gene of the filamentous fungus *Ashbya gossypii*. This heterogonous module permits efficient selection of transformants resistant against geneticin (G418).

A high false rate of integration to the target region may generally occur if PCR products are used, or if a marker has low sequence homology to the target region. In contrast, the KanMX module (G418 marker) serving as a heterologous selectable marker guarantees a high rate of deletion thanks to its dominant resistance even if PCR-DNA fragments are used.

Barcode Sequences for Microarrays

In order to efficiently measure growth rates of a library of (6,000) gene-targeted fission yeast mutants, a practical and systematic strategy is necessary for the growth measurement through a gene chip technique. In this regard, barcode sequences for microarrays are introduced into the deletion cassettes (FIG. 3). These barcode sequences make it easy to detect the strains whose growth is inhibited by a drug in such a manner that a chromosome pool isolated from 6,000 strains is used as a template for PCR amplification of barcodes regions, followed by analysis on a gene chip. The barcode sequences must be specifically designated to each strain, thus requiring a population two or more times greater than that of the genomic 1 DNAs of the strains (each one assigned upstream and downstream of genomic DNA, one genomic DNA flanked by at least two barcode sequences). As long as it satisfies this condition, there is no limitation imparted to the length of the barcode sequences.

In a preferred embodiment of the present invention, the KanMX4 of the deletion cassette is flanked by two copies of a 20-mer gene-specific barcode. The theoretically possible number of 20-mer barcodes is $4^{20}$ because the four bases G, A, T and C are used in the barcode sequences. Barcode sequences used in the present invention are those shown in FIGS. 7 to 55.

Homologous Recombination Regions

A success rate in constructing gene-targeted strains is dependent on properties of strains because it is determined by homologous recombination efficiency which differs from one strain to another. However, the homologous recombination efficiency in the same strain is highly proportional to the length of genomic homologous regions (Michael et al., Gene. 158:113-17; Palaniyandi et al., Nucl Acid Res. 3:2799-2800). Thus, the DNA fragments corresponding to genomic homologous regions must have their lengths optimized in order to construct gene-targeted strains with efficiency.

According to an embodiment of the present invention, this homologous recombination region is 150 bp or greater in length and is positioned at each of 5' and 3' sides in the deletion cassette. Preferably, the homologous recombination region ranges in length from 150 bp to 450 bp. A more preferable embodiment of the present invention provides a deletion cassette in which the homologous recombination region with a length of from 150 to 450 bp is positioned at each of 5' and 3' sides.

TABLE 2

| Construction of Deletion Cassettes | | Yeasts | Homologous Length(bp) | Success rate(%) | Note |
|---|---|---|---|---|---|
| PCR with gene-specific Oligo | Serial PCR | Budding | 45~60 | 81 | |
| | Single Oligo | Budding | 38~50 | 10 | |
| | Single Oligo | Fission | 40 | 1~3 | |
| | 4-Round Serial PCR | Fission | 80 | 50 | Present invention |
| | Block PCR | Fission | 350~450 | 80 | |
| Gene Synthesis | | Fission | 150 | 80~98 | |

Construction of Deletion Cassette for Gene Targeting

The deletion cassette of the present invention plays an essential role in targeting about ~5000 yeast genes in such a manner that a marker gene of the deletion cassette transformed into the yeast is substituted for a target gene. As a prerequisite to the construction of gene-targeted, heterozygous fission yeast mutants, the deletion cassette preferably has a gene structure in which the selectable marker is flanked by the gene-specific barcodes which are in turn respectively inserted to chromosome-homologous recombination regions of suitable lengths (FIG. 1).

In a preferred embodiment of the present invention, the KanMX4 module is designed to express the kanamycin resistant gene of Tn903 in the fission yeast, having the structure in which the resistance gene is preceded by the 381 bp TEF promoter sequence of *Ashbya gossypii* just before the initiation codon ATG thereof and followed by the 242 bp TEF terminator of *Ashbya gossypii* just after the stop codon thereof. When used, the promoter or terminator of the budding yeast (*Saccharomyces cerevisiae*) or the fission yeast itself also acts as an additional chromosome-homologous region, resulting in a false homologous recombination. For this reason, the promoter used in the deletion cassette is preferably from a heterogeneous yeast. The KanMX4 module thus constructed becomes 1,433 bp in length. After the deletion cassette is introduced into the fission yeast through transformation, the marker gene undergoes homologous recombination with a chromosomal target gene, so that the marker gene is inserted into the chromosome while the target gene is deleted.

In an example of the present invention, a primary PCR was performed in the presence of a pair of 70 bp-long 5' and 3' barcode primers, each containing a 20 bp barcode, with the kanamycin resistance gene (Kan$^R$) serving as a template, to afford a Kan$^R$-barcode module (FIG. 2) which was in turn used as a template for secondary PCR with a pair of 60~80 bp primers, each consisting of a 40~60 bp chromosome-homologous recombination sequence and a 20 bp-long 5' or 3' terminal region of the Kan$^R$-barcode module, to produce a deletion cassette, useful as a component of the present invention.

Four-Round Serial PCR, Block PCR and Gene Synthesis for Construction of Deletion Cassette The construction of the deletion cassette for gene targeting in accordance with the present invention is accomplished by (1) four-round serial PCR; (2) block PCR; or (3) gene synthesis, preferably as follows.

(1) The term "four-round serial PCR", as used herein, is intended to refer to PCR which is performed four times in series. A primary PCR is performed with a pair of about 70 bp-long 5' and 3' barcode primers to afford a barcode module which is in turn used as a template in three successive PCRs with a pair of 50-mer primers for the first two and with a pair of 40-mer primers for the final one, so as to give a gene-specific barcode and a 80 bp-long gene-homologous recombination region.

(2) The term "block PCR", as used herein, is intended to refer to a block PCR which is performed with 5' and 3' DNA fragments for homologous recombination on the chromosome, which are separately produced to a length of 350~500-bp in length by PCR, in admixture with the produced $Kan^r$-barcode module, to afford a deletion cassette.

(3) The term "gene synthesis" is quite different from PCR and enjoys the following advantages: first, the gene synthesis method can be conducted by one round of phosphorylation and ligation and two rounds of PCR while the four-round PCR is accomplished by four rounds of PCR and four rounds of purification. Thanks to the simplicity thereof, the gene synthesis achieved the genome-wide construction of heterozygous deletion mutants at a success rate of 90% or higher whereas a success rate of 80% was obtained with the block PCR (Table 2); secondly, the gene synthesis can be conducted in series on 96-well plates, thus improving workability. For example, one experienced worker can construct ten strains a week through conventional PCR. In contrast, gene synthesis enables a worker to construct 100 or more strains a week, increasing the efficiency at least 10 times. Finally, only two rounds of PCR are needed whereas the conventional PCR is conducted four times in series, which decreases the possibility of point mutations by two or more times. For instance, 20 strains randomly selected from each group of the mutants constructed according to the methods were subjected to PCR for the amplification of an approximately 2.1-kb target gene, followed by DNA sequencing to find mutations at a rate of 0.2 bases/1 kb, which is two or more times lower than 0.5 bases/1 kb in the conventional PCR.

FIG. 1 is a gene map illustrating a deletion cassette constructed by gene synthesis according to the present invention. The methods (1) and (2) are common in that deletion cassettes are constructed on the basis of PCR, but the method (3) is different in that the construction of deletion cassettes is based on the ligation of synthetic oligonucleotides, but not on PCR. Particularly, the method (3) permitted successful construction of about 200 heterozygous gene-targeted mutants which are difficult to make by conventional PCR methods, showing a success rate as high as 97% from a total 4,988 genes of the fission yeast.

In accordance with an aspect thereof, the present invention provides a high-throughput screening system of in vivo drug's modes of action in which a library of the heterozygous deletion mutants of fission yeast is prepared with the deletion cassettes constructed as described above and is applied to order-made gene chips. In a preferred example of the present invention, the performance of the system was demonstrated by use of the antifungal agent terbinafine.

Heterozygous Fission Yeast

Among the fission yeast group are *Schizosaccharomyces octosporus* and *Schizosaccharomyces pombe*. Any fission yeast may be used in the present invention. The mutant strains transformed with the deletion cassettes are heterozygous deletion mutants in which the gene-specific sequences of the deletion cassettes are exchanged with the chromosomal target genes of the fission yeast by homologous recombination to delete the target genes from the chromosome of the fission yeast.

In a preferable embodiment, the fission yeast may be *Schizosaccharomyces pombe*, but is not limited thereto. The fission yeast *Schizosaccharomyces pombe*, useful in a preferable embodiment of the present invention, was first isolated from African millet beer and is widely used as a model eukaryote for cell and molecular studies as well as in the production of foods such as beer, breads, etc. *S. pombe* is particularly useful in investigating the cell cycle of cells which proliferate through equal division. Introns are distributed among 43% of *S. pombe* genes, showing the feature of higher eukaryotic organisms. Found to have a compact genomic structure with about 5,000 ORFs (open reading frames), the fission yeast is in addition used as a material suitable for gene analysis. Further, *S. pombe* is recognized for making broad contributions to the life sciences, particularly with applications involved with the development of new drugs.

In accordance with a further aspect thereof, the present invention pertains to a gene-targeted, heterozygous deletion mutant of fission yeast which is prepared with a gene-target deletion cassette comprising a selectable marker gene, barcode gene sequences for microarray analysis, and homologous recombination regions.

In accordance with still a further aspect thereof, the present invention pertains to a library of gene-targeted heterozygous fission yeast mutants prepared by the method of the present invention.

In accordance with still another aspect thereof the present invention pertains to a method for screening a drug's modes of action by chemically treating a library of heterozygous fission yeast mutants, culturing the chemically treated library, isolating total genomic DNA from the culture, and applying the isolated genomic DNA to microarray GeneChip or to real-time PCR.

As a tool for identifying a drug's modes of action, a library of heterozygous fission yeast mutants is provided. To identify "a drug's mode of action" is essential to the improvement of preexisting drugs in medicinal efficiency and the development of a new drug free of or with few side effects. The method for screening a drug's mode of action in accordance with the present invention comprises the steps of:

1) treating a library of heterozygous fission yeast mutants with a chemical;

2) culturing the library of the chemically treated, heterozygous fission yeast mutants;

3) isolating genomic DNA from the cultured library; and 4) measuring and analyzing growth rates of the mutants with the isolated genomic DNA applied on microarray gene chips to detect strains which are relatively inhibited from growing.

As long as it inhibits the growth of the mutants, any chemical may be used in the present invention. In a preferred example of the present invention the antifungal agent terbinafine, which targets the gene erg1, was used to examine whether the screening system of a drug's modes of action worked well or not.

As long as it is known in the art, any technique may be used to isolate genomic DNA from the fission yeast. In a preferred example of the present invention, the fungal/bacterial DNA kit (Zymo Research, catalog #D6005) was employed to obtain genomic DNA.

The term "gene chip" or "GeneChip", as used herein, refers to a tool for analyzing the expression of genetic information, which is typically composed of an arrayed series of hundreds to tens of thousands of microscopic spots of DNA oligonucleotides on a solid support of about 1 $cm^2$.

The DNA oligonucleotides of known, specific genetic information are arranged on the surface of the chip and are used as probes to hybridize a target under high-stringency conditions. Probe-target hybridization is usually detected and quantified by fluorescence-based detection of fluorophore-labeled targets to determine a relative abundance of nucleic acid sequences in the target. These gene chips are not only useful for gene studies, but also can detect gene-related diseases quickly. Further, these new analysis systems find a wide spectrum of applications in, for example, selecting or designing optimal customized drugs.

As long as it recognizes the gene-specific barcode sequence inserted to the deletion cassette, any gene chip may be used in the present invention. A preferable embodiment of the present invention employed deletion cassettes with 20-mer barcodes inserted thereinto, and an order-made GeneChip with a serial number of KRIBBSP1-a520429 from Affymetrix to detect the barcodes.

In an alternative embodiment of the present invention, real-time PCR, instead of GeneChip, was performed with inter-chelating dye or flourophore-labeled probe to screen a drug's modes of action. A detailed description will be given of detection with probes, below.

TaqMan probes and cycling probes have been developed for use as fluorescent probes in real-time PCR. The former is a technology utilizing the 5'→3' exonuclease activity of the Taq DNA polymerase for measuring the amount of target sequences in the samples while the cycling probe technology is a method utilizing a combination of chimera probe, composed of RNA and DNA, and RNase H. In this method, one end of the probe is labeled with a fluorescent substance and the other end is labeled with a quencher, which quenches the fluorescence emitted from the fluorescent substance. When this probe forms a hybrid with the complementary sequence of amplified product, RNase H specifically cuts the RNA region of this probe, resulting in emissions of strong fluorescence. Below, a detailed description will be given of the TaqMan probe technology for screening a drug's modes of action.

In a preferable embodiment of the present invention, real-time PCR is conducted with a Taqman probe in addition to common primers. A Taqman probe is an oligonucleotide which is labeled with a reporter fluorophore at the 5' end and with a quencher at the 3' end. During PCR, the probe anneals specifically between the forward and reverse primers to an internal region of the PCR product at the annealing step, with the fluorescence quenched by the quencher. While the polymerase then carries out the extension of the primers and replicates the template to which the TaqMar™ probe is bound, the 5' exonuclease activity of the polymerase cleaves the probe, releasing the reporter molecule away from the close vicinity of the quencher. As a result, the fluorescence intensity of the reporter dye increases and can be detected to determine the expression of the target gene. In the present invention, a Taqman™ probe may be constructed to have a barcode sequence as the oligonucleotide sequence. In this case, real-time PCR with each Taqman probe gives quantitative data on the real time expression of corresponding barcodes, on the basis of which significantly increased or decreased regions can be regarded as a drug's modes of action.

In accordance with still another aspect thereof, the present invention pertains to a novel drug-screening kit, comprising the library of heterozygous fission yeast mutants.

The drug-screening kit of the present invention is used in the method for screening a drug's modes of action. In greater detail, the screening kit is utilized in screening novel drugs as well as a drug's modes of action by 1) culturing the library of heterozygous fission yeast mutants of the screening kit in media containing respective drug candidates and 2) comparatively analyzing the growth of the fission yeast mutants to detect growth-inhibited fission yeast mutants.

MODE FOR INVENTION

A better understanding of the present invention may be obtained through the following examples which are set forth to illustrate, but are not to be construed as limiting the present invention.

Example 1

Construction of Deletion Cassette by Four-Round Serial PCR or Block PCR

Deletion cassettes can be constructed in two different PCR techniques: four-round serial PCR and block PCR. These two PCR-based methods are common in preparing a Kan$^r$-barcode module in advance. The base sequence of KanMX4 is well known in the art and is not described specifically. Primary PCR was performed with a pair of 70-mer 5'- and 3'-barcode primers, each containing a gene-specific barcode while KanMX4 served as a template to prepare a Kan$^r$-barcode module (FIG. 2). After electrophoresis on agarose gel stained with ethidium bromide (EtBR), the Kan$^r$-barcode module thus prepared was extracted from the gel by excising under a UV lamp.

The four-round serial PCR for constructing deletion cassettes is similar to the conventional one used for constructing gene-targeted budding yeast or fission yeast mutants, but different thereto in that 80-bp homologous recombination region is added to either ends of the deletion cassette (Giaever et al., Nature Genetics 14:450-56). Dr. Giaever et al. succeeded in targeting 90% or more of the total 6000 genes of the budding yeast by providing a 45-bp recombination region in one PCR, with Kan$^r$-barcode module serving as a template. As for the fission yeast, however, the 45-bp homologous recombination region is too short to effectively induce homologous recombination on the genome. Thus, the method used for the construction of gene-targeted fission yeast mutants was modified such that PCR was performed three times in series with a pair of 50-mer primers for first two rounds and with a pair of 40-mer primers for the last round, to give a 80-bp homologous recombination region together with a gene-specific barcode (FIG. 3).

This four-round serial PCR was successfully applied only to a quarter of the total 4,988 genes of the fission yeast, with a success rate of 50% or higher in the construction of mutant strains, but failed for the remaining three fourths. Thus, the homologous recombination region was extended using block PCR (FIG. 4). In the block PCR, 5' and 3' DNA fragments for chromosome-homologous recombination, each 350~500 bp long, are separately synthesized by PCR and then subjected, together with the purified Kan$^r$-barcode module, to block PCR to prepare a deletion cassette in which the 5' and 3' 350~500 bp DNA fragments are fused to 5' and 3' ends of the Kan$^r$-barcode module, respectively. As a result, the chromosome-homologous recombination regions in the deletion cassette are extended to 350~500 bp from the 80 bp of the four-round serial PCR, remarkably increasing the construction efficiency of deletion mutants to 90% from 50%.

Example 2

Construction of Deletion Cassette by Gene Synthesis

Even the PCR technology described above failed to prepare gene-targeted mutants for as many as 4% of the total genes. The reason is because the high contents of both adenine (A) and thymine (T) in the promoter and the terminator of the gene do not allow for primer sites of conventional PCR. In consideration of this problem, the gene synthesis method was employed. The present invention is the first to use gene synthesis in constructing deletion cassettes and preparing deletion fission yeast mutants.

A deletion cassette was designed to consist of three fragments: 1) 5' chromosome-homologous region bearing 5' common liker sequence and 5' barcode, 2) kanamycin resistance gene (Kan$^r$), and 3) 3' barcode and 3' chromosome-homologous region bearing 3' common liker sequence. To connect these three fragments into a one line, overlapping link oligo-sequences are arranged between the fragments to be connected with each other (FIG. 5). A length of 250 bp was given as the length of the chromosome-homologous region, which is the most important factor to determine the construction efficiency of mutants. The 5' chromosome-homologous region was identical to the chromosomal nucleotide sequence stretching in the direction toward the promoter from the initiation codon ATG by 250 bp while the 3' chromosome-homologous region was identical to the chromosomal nucleotide sequence stretching in the direction toward poly-A from the stop codon TGA, TAG or TAA, by 250 bp.

The 5' and the 3' chromosome-homologous region, each 250 bp long, are different from one gene to another and the description of their nucleotide sequences is omitted because anyone skilled in the art can infer them.

The link oligo-sequences in the fragments to be linked to each other are designed to overlap with each other, with no gaps between the fragments, so that a double-stranded deletion cassette DNA fragment, albeit having nicks thereon between the fragments, can be obtained only by overlapping the oligo-sequences. On the basis of the Santa Lucia Calculations, all of the oligo-sequences were designed to have a Tm value of 60±3° C. (Santa Lucia PNAS. 95:1460-5). Two relatively short oligo-sequences, 12~16 bp long, were respectively arranged at the opposite terminal regions of the deletion cassette, producing blunt ends. Then, treatment with ligase sealed the nicks to give an intact deletion cassette DNA template.

Example 3

Transformation of Deletion Cassette and Identification of Gene-Targeted Mutants Using the lithium acetate method, the deletion cassette prepared through Examples 1 and 2 was transformed into diploid fission yeast SP286 strains (ade6-M210/ade6-M216, ura4-D18/ura4-D18, leu1-32/leu1-32) (Moreno et al., Methods Enzymol. 194:795-823). The transformed strains were spread over YES agar plates and cultured at 30° C. for 3~4 days to form colonies. Colony PCR was performed to examine whether desired genes were targeted. A small amount of cells were picked from edges of grown colonies on agar plates and suspended in deionized water. A portion of the suspension was subjected to PCR with a pair of primers. As shown in FIG. 6, colony PCR was performed with a pair of CP5 and CPN1 or CPN10 for the 5' side of the deletion cassette inserted into the chromosome and with a pair of CP3 and CPC1 or CPC3 for the 3' side of the deletion cassette. CP5 and CP3 were located 100~200 bp upstream and downstream of corresponding chromosome homologous regions, respectively. CPN1 and CPC1 were located within the KanMX4 gene, with a distance of 200 bp from 5' and 3' ends thereof, respectively, while CPN10 and CPC3 were also located within the KanMX4 gene, with a distance of 300 bp from 5' and 3' ends thereof, respectively. Accordingly the colony PCR products thus obtained had a length of 300~400 bp plus the length of the chromosome homologous region, that is, 80~450 bp, amounting to 500~1,000 bp in total. Reference may be made to Korean Patent No. 10-0475645 for reaction conditions of colony PCR.

The base sequences of CP5 and CP3 which are different depending on the genes are not described in detail because they are readily apparent to those skilled in the art. Base sequences of CPN1, CPN10, CPC1 and CPC3 are given, along with their sequence identification numbers, in Table 3, below.

TABLE 3

| Oligo Names | Base Sequences | SEQ ID NOS. |
|---|---|---|
| CPN1 | 5'-CGTCTGTGAGGGGAGCGTTT-3' | 1 |
| CPN10 | 5'-GATGTGAGAACTGTATCCTAGCAAG-3' | 2 |
| CPC1 | 5'-TGATTTTGATGACGAGCGTAAT-3' | 3 |
| CPC3 | 5'-GGCTGGCCTGTTGAACAAGTCTGGA-3' | 4 |

Example 4

Determination of Base Sequences of Gene-Specific Barcodes and their PCR Amplification Gene-specific barcodes must be needed in order to systemically identify strains using a microarray GeneChip as will be described in Example 5, below. In this regard, two gene-specific barcodes, each 20 bp, were given to 5' and 3' sides of the deletion cassette, respectively (FIG. 1). According to the gene database of the Sanger Institute, 4,988 genes are present in the fission yeast. Hence, as shown in FIGS. 7 to 55, a total of 9,976 barcodes were assigned to the 4,988 genes, with two per gene. The barcodes were named in such a manner that the systematic names of corresponding genes were followed by the extension _UP or _DN. For example, barcodes specific for the gene SPAC1002.09c were named SPAC1002.09c_UP for 5' up-tag, identified by SEQ ID NO. 18, and SPAC1002.09c_DN for 3' down-tag, identified by SEQ ID NO. 19 (FIG. 7). Barcodes were thus artificial DNA sequences which were not present on the chromosome of the fission yeast and were designed to have a Tm value of 60±1° C. according to a computer algorithm.

Example 5

Screening of A Drug's Mode of Action Using a Library of Gene-Targeted Diploid Fission Yeast Mutants A modification of the Giaever's method for screening drug's modes of action in the budding yeast on the basis of haploinsufficiency was applied to the fission yeast in accordance with the present invention (FIG. 56) (Giaever et al., Nature Genetics 14:450-56, Pierce et al., Nature Protocols 11:2958-2974, Pierce et al., Nat Methods: 601-3).

The analysis of a drug's modes of action by use of a GeneChip comprises the following seven steps: 1) pooling of strain libraries, 2) activation, chemical treatment and sampling of a frozen strain pool, 3) isolation of chromosomal DNA and PCR amplification of barcode labels, 4) Order of GeneChip from Affymetrix, 5) hybridization, 6) staining, washing and colorimetry, and 7) result analysis.

1) Pooling of Strain Libraries

A pool in which the mutants were equally mixed was prepared in the manner illustrated in FIG. 57. Because it was not easy to handle a library of 4,884 gene-targeted heterozygous mutants at the same time, they were divided into unit packages of 96 mutants. In detail, 96 mutants were cultured at 30° C. for 3 days on YES agar plates containing G418 at a concentration of 200 mg/ml, followed by incubation at 30° C. for 3 days on 96-well type plates. The strains cultured on the 51 plates were scraped, and suspended in 5.5 ml of respective 2× YES broths. After the addition of glycerol to the concentration of 30%, the 51 cultures were aliquoted at a volume of 1 ml and stored at −80° C. All of the 51 1 ml-aliquots in cryogenic storage were pooled together to afford a library of the mutants which was then aliquoted at a volume of 1 ml and stored at −80° C. A total of $5 \times 10^7$ cells were used so that at least 10,000 cells were assigned to one mutant strain per one round of screening a drug's modes of action.

2) Activation, Chemical Treatment and Sampling of Frozen Strain Pool

Prior to chemical treatment, the strain pool stored at −80° C. was activated. After being thawed, an aliquot of the strain pool was initially inoculated into a YES broth at $O.D_{600}=0.2$ and grown at 25° C. to $O.D_{600}=2.0$. These activated strains were diluted to a density of $O.D_{600}=0.2$ and treated with a chemical at a suitable concentration, followed by sampling therefrom once every three sub-cultures over a total of 20~30 subcultures (typically 4 hours are required for one sub-culture of the fission yeast). Since it was easy to determine the inhibitory activity of the chemical on the growth of cells when the strains must grow at a constant rate without the influence of nutrients, the sampled strains were diluted again at a density of $O.D_{600}=0.2$ in fresh broth containing the chemical. A sample taken from chemical-free broth was used as a control. The samples were centrifuged to give cell pellets which were then stored at −80° C. Genomic DNA was isolated from all of the samples at the same time and subjected to GeneChip analysis.

In order to determine the concentration of the chemical for the treatment, 50% inhibitory concentration ($IC_{50}$) was first measured. Wild-type SP286 strain was grown to $O.D_{600}=2.0$ in YES broth and inoculated with from 5- to 10-fold serial dilutions of the chemical to $O.D_{600}=0.1$, followed by incubation at 30° C. for 24 hours. At each concentration of the chemical, the cultures were measured for final $O.D_{600}$ values which were then plotted against Log [Chemical Concentration]. On the basis of these plots, $IC_{50}$ values were automatically calculated using Prism Software (version 3.0, GraphPad Software Inc., San Diego, Calif.). Scientific experience made it possible to determine the concentrations of the chemical at around the appropriate $IC_{50}$ values.

3) Isolation of chromosomal DNA and PCR Amplification of Barcode Label

Using a Fungal/Bacterial DNA kit (Zymo Research, catalog # D6005), 2-4 µg of genomic DNA was isolated from 200 mg of the cell sample. A 20-~50-fold dilution of the isolated genomic DNA was mixed with a 200-fold dilution of Pico Green dye (Pico Green® dsDNA Assay Kit (Invitrogen Inc. cat # P11495) at a volume ratio of 1:1, followed by quantification with NanoDrop (ND-1000, NanoDrop Inc.). 200 ng of each sample was used for labeling PCR.

For use as probes in GeneChip, only the barcodes present in the isolated genomic DNAs were amplified by PCR using biotin-labeled primers. To this end, first, base sequences of common primers for the amplification of the 20-bp barcodes were determined. It was important to design the common primers which did not form non-specific bonds with the genome of the fission yeast. The base sequences determined through algorithm and serial experiments are given in Table 4, below. Biotin, serving as a label in the PCR amplification of the barcodes, was conjugated to the 5'-ends of the primers which are directed towards the kanamycin resistance gene. The PCR products of the 5' and the 3' barcode were 70 bp and 73 bp in length. Solutions and conditions for PCR amplification are summarized in Table 5, below. After completion of PCR, PCR products were analyzed for length and amount by the electrophoresis of 5 µl of the PCR reaction in 3% agarose gel and stored at 4° C. in a refrigerator until hybridization. About 30 µl of the PCR product was used for each hybridization.

TABLE 4

| Oligo Names | Positions | Directions | Base Sequences | SEQ ID NOS. |
|---|---|---|---|---|
| U1 | 5' Up-tag | Sense | 5'-GCTCCCGCCTTACTTCGCAT-3' | 5 |
| U2 | | Anti-sense | 5'-Biotin-CGGGGACGAGGCAAGC TAA-3' | 6 |
| D1 | 3' Down-tag | Sense | 5'-Biotin-GCCGCCATCCAGTGTC G-3' | 7 |
| D2 | | Anti-sense | 5'-TTGCGTTGCGTAGGGGGG-3' | 8 |

TABLE 5

| Sol'n | Stock | Final Conc./Amount | Volumes (µl) |
|---|---|---|---|
| Water (H$_2$O) | | | 75-x |
| PCR Buffer | 10X | 1X | 10 |
| MgCl$_2$ | 20 mM | 2.5 mM | 10 |
| dNTP | 10 mM | 0.2 mM | 2 |
| Primer Mix | 50 uM | 1 µM | 2 |
| Taq Polymerase | 5 U/µl | 5 U | 1 |
| Genomic DNA | | ~200 ng | x |
| Final Vol. | | | 100 |
| PCR Conditions | 94° C., 2 min, 1 cycle - (94° C., 30 s; 58° C., 30 s; 72° C., 30 s) 29 cycles - 72° C., 3 min, 1 cycle | | |

4) Order of GeneChip from Affymetrix

A made-to-order GeneChip with serial number KRIBBSP1-a520429 from Affymetrix was used to recognize the 20-bp barcodes specifically inserted into the mutant strains (FIG. 58). On this DNA chip with a size of 0.8×0.8 cm were planted 100,000 probes which each have a feature of 11×11 µm. The probes consisted of 1) perfect match (PM) and mismatch (due to mismatch bases assigned to middle sites of barcodes) with 5' and 3' barcodes (each 10,000) in triplicate (60,000 in total); 2) 10,000 control probes for minimizing false positive signals induced by non-specific hybridization; 3) 20,000 spare probes for barcodes; and 4) 10,000 basic structure probes necessary for indicating the manufacturer Affymetrix and Oligo texts and compartmenting.

5) Hybridization

Hybridization between the GeneChip from Affymetrix and the probes obtained by PCR in 3) was conducted as follows. As shown in Table 6, first, the hybridization solution comprising a biotin-labeled text oligo-mix and a blocking oligo-mix in addition to the biotin-labeled barcode probes was mixed in a 1.5 ml tube. The biotin-labeled text oligo-mix gave a standard to the optical recognition system upon analysis on the GeneChip. The blocking oligo-mix composed of 8 oligonucleotides served to block the common primers within the barcode and the gap between the primers and the barcode to expose only the 20-bp barcodes in single strands, thereby allowing the sense single strands to hybridize with the antisense probe oligonucleotides of the GeneChip. Each of the 8 oligonucleotides was used as a 300 pM stock. In the blocking oligo-mix, 5U-Block, K5U-Block, 5U-Block (rev comp) and K5U-Block (rev comp) were each present at a concentration of 37.5 pmole/µl while 3U-Block, K3U-Block, 3U-Block (rev comp) and K3U-Block (rev comp) were each present at a concentration of 12.5 pmole/µl. Immediately after being boiled at 98° C. for 5 min, the hybridization solution was quenched in ice water to expose the 20-bp sense barcode sequences in single strands. To the GeneChip which was pre-treated for 5 min with 140 µl of hybridization buffer was injected 140 µl of the hybridization solution, followed by hybridization at 42° C. for 16 hours.

6) Staining and Washing and Colorimetry

After completion of the hybridization, the GeneChip was stained with phycoerythrin-conjugated streptavidin using a fluidics station (Affymetrix). Streptavidin was strongly bound to the biotin to give fluorescence, affording the quantification of the biotin-labeled barcodes hybridized with the probes on the GeneChip.

The Fluidics station was used according to the protocol recommended by the manufacturer using staining solution (600 µl: 20×SSPE 180.57 µl+50×Denhart's solution 11.94 µl+10% Tween20 0.597 µl+phycoerythrin-conjugated streptavidin 1.019 µl+deionized water 405.874 µl) and a washing solution (Wash A: 20×SSPE 300 ml, 10% Tween 1 ml, distilled water 699 ml in 1 liter; Wash B: 20×SSPE 150 ml, 10% Tween 1 ml, distilled water 849 ml in 1 liter). Thereafter, the GeneChip was scanned with GeneChip® Scanner 3000 G7 (Affymetrix) to detect fluorescence.

TABLE 7

| Conditions | No. of Round | Notes |
| --- | --- | --- |
| Wash A1 Recovery Mixes | 0 | |
| Wash A1 Temperature (° C.) | 25 | |
| Number of Wash A1 Cycle | 2 | |
| Mixes per Wash A1 Cycle | 4 | |
| Wash B Recovery Mixes | 0 | |
| Wash B Temperature (° C.) | 42 | |
| Number of Wash B Cycle | 6 | |
| Mixes per Wash B Cycle | 4 | |
| Stain Temperature (° C.) | 25 | |
| First Stain Time (seconds) | 0 | (dummy step) |
| Wash A2 Recovery Mixes | 0 | (dummy step) |
| Wash A2 Temperature (° C.) | 25 | |
| Number of Wash A2 Cycle | 1 | |
| Mixes per Wash A2 Cycle | 2 | |

TABLE 6

| Solutions | | Compositions and Base Sequences | Vol (µl) | SEQ ID NOS. |
| --- | --- | --- | --- | --- |
| 5' Up- and 3' Down-tag | | 4,884 Gene-specific Up and Down barcodes | 60 (each 30) | |
| 2× Hybridization Buffer | | 200 mM MES, 2M Na+, 40 mM EDTA 0.02% Tween20 | 75 | |
| Text Oligo (20 fmole/µl) | | 5'-biotin-GTCGTCAAGATGCTACCGTTCAGGA-3' | 0.5 | 9 |
| Blocking Oligo-Mix | 5U-Block | 5'-CGCTCCCGCCTTACTTCGCATTTAAA-3' | 12 | 10 |
| | K5U-Block | 5'-GGGGACGAGGCAAGCTAAGATATC-3' | | 11 |
| | 3U-Block | 5'-TTGCGTTGCGTAGGGGGGATTTTAAA-3' | 12 | 12 |
| | K3U-Block | 5'-CGCCATCCAGTGTCGAAAAGTATC-3' | | 13 |
| | 5U-Block (rev comp) | 5'-TTTAAATGCGAAGTAAGGCGGGAGCG-3' | | 14 |
| | K5U-Block (rev comp) | 5'-GATATCTTAGCTTGCCTCGTCCCC-3' | | 15 |
| | 3U-Block (rev comp) | 5'-TTTAAAATCCCCCCTACGCAACGCAA-3' | | 16 |
| | K3U-Block (rev comp) | 5'-GATACTTTTCGACACTGGATGGCG-3' | | 17 |
| 50× Denhardt's Sol'n | | 1% Ficoll 400, 1% PVP, 1% BSA | 3 | |
| | | Total volume | 150.5 | |

TABLE 7-continued

| Conditions | No. of Round | Notes |
|---|---|---|
| Second Stain Time (seconds) | 600 | |
| Third Stain Time (seconds) | 0 | (dummy step) |
| Wash A3 Recovery Mixes | 0 | (dummy step) |
| Wash A3 Temperature (° C.) | 25 | |
| Number of Wash A3 Cycles | 6 | |
| Mixes per Wash A3 Cycle | 4 | |
| Holding Temperature (° C.) | 25 | |

7) Result Analysis

The binding between the PCR-amplified gene-specific sense barcodes and the antisense oligonucleotide probes planted on the GeneChip could be quantified by the fluorescent intensity detected. The fluorescence values measured were stored in files with the extension name cel. Strong fluorescent intensity means that cells with corresponding genes are predominantly growing. On the other hand, weak fluorescent intensity means the inhibition of cell growth. Based on the ANOVA/ANCOVA model, fluorescent data from the GeneChip were analyzed for the heterozygous gene-targeted mutants which were inhibited from growing.

According to the ANCOVA model, the drug-induced inhibition of cell growth is expressed as the reduced passage number which can be obtained according to the following formula.

Reduced passage No. by drug in unit time (12 hrs)=
Changed passage No. upon drug treatment in
unit time (12 hrs)−Changed passage No. in the
absence of drug in unit time (12 hrs)

Passage No. is calculated according to the following formula:

Passage No.=$\log_2$(Fluorescent Intensity of Gene $X$
at a predetermined time)−$\log_2$(Fluorescent
Intensity of Gene $X$ at the previous time)

Example 6

Screening of Terbinafine's Modes of Action Using GeneChip and Verification

In order to screen terbinafine's modes of action with the GeneChip, first, the treatment concentrations of drug were determined by the measurements of $IC_{50}$ obtained in the above-mentioned method. In this regard, relative rates of drug-induced inhibition against cell growth were obtained by treating the cells with terbinafine at doses of 0.1 nM, 1 nM, 5 nM, 10 nM, 50 nM, 100 nM, 500 nM and 1 nM. Analysis with Prism software determined $IC_{50}$=40 nM (FIG. 11).

After the treatment of a strain pool with 40 nM of terbinafine, as shown in Table 8, samples were taken every three passages (approximately 12 hours) till 30~35 passages, GeneChip analysis was performed with 13 controls and 12 drug-treated samples.

TABLE 8

| Chip Nos. | Specimen Group | Specimen Names | Accumulated Passages (Round) | Passage Time(h) |
|---|---|---|---|---|
| 1 | Chip control: | Strain mix in Glycerol | | |
| 2 | Cell activation | Activation Stage 1 | | 6.9 |
| 3 | | Activation Stage 2 | | 6.7 |
| 4 | | Activation Stage 3 | | 4.2 |
| 5 | Drug control: | Control Data Point 1 | 3.1 | 3.6 |
| 6 | YES media | Control Data Point 2 | 6.6 | 3.9 |
| 7 | | Control Data Point 3 | 9.4 | 3.6 |
| 8 | | Control Data Point 4 | 12.8 | 3.8 |
| 9 | | Control Data Point 5 | 16.7 | 3.7 |
| 10 | | Control Data Point 6 | 21.2 | 3.6 |
| 11 | | Control Data Point 7 | 25.6 | 3.5 |
| 12 | | Control Data Point 8 | 32.7 | 3.4 |
| 13 | | Control Data Point 9 | 35.9 | 3.8 |
| 14 | Drug-Treated: | Drug Data Point 1 | 3.1 | 3.6 |
| 15 | YES + 40 nM | Drug Data Point 2 | 6.3 | 4.3 |
| 16 | Terbinafine | Drug Data Point 3 | 8.6 | 4.3 |
| 17 | | Drug Data Point 4 | 10.9 | 5.6 |
| 18 | | Drug Data Point 5 | 13.7 | 5.2 |
| 19 | | Drug Data Point 6 | 17.1 | 4.7 |
| 20 | | Drug Data Point 7 | 20.9 | 4.0 |
| 21 | | Drug Data Point 8 | 23.8 | 4.0 |
| 22 | | Drug Data Point 9 | 26.7 | 4.5 |
| 23 | | Drug Data Point 10 | 29.5 | 4.1 |
| 24 | | Drug Data Point 11 | 32.3 | 4.3 |
| 25 | | Drug Data Point 12 | 34.9 | 4.4 |

The gene candidates which were ranked as the top 10 (or top 20) by ANCOVA analysis, defined as cell growth over time after treatment with terbinafine, are summarized in Table 9, below. The erg1 gene, known as a terbinafine's mode of action, codes for squalene monooxygenase, which plays an important role in the biosynthesis of the membrane component ergosterol. The screening of terbinafine's modes of action with the conventional budding yeast also resulted in a first ranking for the erg1 gene. This coincidence demonstrates that the system of screening drug's modes of action with a library of the gene-targeted fission yeast mutants in accordance with the present invention works properly.

Since the drug's modes of action detected with the GeneChip might include the false positive signals resulting experiment errors and false chip analysis, all the top 10 drug's modes of action, except non-specific ribosome-related genes, were cultured again on YES agar plates containing terbinafine. As shown in FIG. 60, the same results as in the chip were obtained for the genes erg1 and pmm1 whereas there was a difference from the chip result on the smb1 gene. Therefore, the genes erg1 and pmm1 within the red boxes were verified as being targets of terbinafine.

Taken together, the data obtained in the examples demonstrate that the present invention is very useful in accurately searching for novel drug's modes of action as well as already known target proteins.

TABLE 9

| Nos. | Systematic Gene Names | Target Genes | Description of Genes |
|---|---|---|---|
| 1 | SPBC713.12 | erg1 | squalene monooxygenase Erg1 (predicted); similar to S. cerevisiae YGR175C |
| 2 | SPCC622.06c | | dubious; similar to S. pombe SPCC622.03c; tandem duplication; ORF in compositionally biased region |
| 3 | SPAC24H6.07 | rps901 | 40S ribosomal protein S9; similar to S. cerevisiae YPL081W and YBR189W; similar to S. pombe rps902 |

TABLE 9-continued

| Nos. | Systematic Gene Names | Target Genes | Description of Genes |
|---|---|---|---|
| 4 | SPBP23A10.07 | rpa2 | DNA-directed RNA polymerase I complex subunit Rpa2; similar to *S. cerevisiae* YPR010C |
| 5 | SPAC26A3.08 | smb1 | small nuclear ribonucleoprotein (snRNP) (subunit B); complexed with Cdc5p (PMID 11884590); similar to *S. cerevisiae* YER029C |
| 6 | SPBC17G9.07 | rps2402 | 40S ribosomal protein S24; similar to *S. cerevisiae* YER074W and YIL069C |
| 7 | SPAC1F7.13c | rpl801 | 60S ribosomal protein L2A; similar to *S. cerevisiae* YFR031C-A and YIL018W |
| 8 | SPBC12D12.03 | cct1 | chaperonin-containing T-complex alpha subunit Cct1; similar to *S. cerevisiae* YDR212W |
| 9 | SPCC1223.05c | rpl3702 | 60S ribosomal protein L37; similar to *S. cerevisiae* YLR185W and YDR500C |
| 10 | SPAC1556.07 | pmm1 | phosphomannomutase; similar to *S. cerevisiae* YFL045C |

INDUSTRIAL APPLICABILITY

As described hitherto, the present invention provides a deletion cassette with two 20-mer gene-specific barcodes and two 250-~350-bp homologous regions at both ends thereof, which is very useful in constructing gene-targeted yeast mutants. A library of the heterozygous gene-targeted yeast mutants can be used to systematically screen a drug's modes of action on a genomic level, thus affording the effective development of new drugs.

Although the preferred embodiments of the present invention have been disclosed for illustrative purposes, those skilled in the art will appreciate that various modifications, additions and substitutions are possible, without departing from the scope and spirit of the invention as disclosed in the accompanying claims.

SEQUENCE LISTING (9997 sequences)

SEQ ID NO: 1 - DNA, 20 bp, Artificial
  confirm PCR primer
cgtctgtgaggggagcgttt

SEQ ID NO: 2 - DNA, 25 bp, Artificial
  confirm PCR primer
gatgtgagaactgtatcctagcaag

SEQ ID NO: 3 - DNA, 22 bp, Artificial
  confirm PCR primer
tgattttgatgacgagcgtaat

SEQ ID NO: 4 - DNA, 25 bp, Artificial
  confirm PCR primer
ggctggcctgttgaacaagtctgga

SEQ ID NO: 5 - DNA, 20 bp, Artificial
  UP tag priming sequence 1 (U1)
gctcccgccttacttcgcat

SEQ ID NO: 6 - DNA, 19 bp, Artificial
  UP tag priming sequence 2 (U2)
cggggacgaggcaagctaa

SEQ ID NO: 7 - DNA, 17 bp, Artificial
  DOWN tag priming sequence 1 (D1)
gccgccatccagtgtcg

SEQ ID NO: 8 - DNA, 18 bp, Artificial
  DOWN tag priming sequence 2 (D2)
ttgcgttgcgtagggggg

SEQ ID NO: 9 - DNA, 25 bp, Artificial
  at_KRIBB_SP1
gtcgtcaagatgctaccgttcagga

SEQ ID NO: 10 - DNA, 26 bp, Artificial
  Blocking oligonucleotide
cgctcccgccttacttcgcatttaaa

SEQ ID NO: 11 - DNA, 24 bp, Artificial
  Blocking oligonucleotide
ggggacgaggcaagctaagatatc

SEQ ID NO: 12 - DNA, 26 bp, Artificial
  Blocking oligonucleotide
ttgcgttgcgtaggggggattttaaa

SEQ ID NO: 13 - DNA, 24 bp, Artificial
  Blocking oligonucleotide
cgccatccagtgtcgaaaagtatc

SEQ ID NO: 14 - DNA, 26 bp, Artificial
  Blocking oligonucleotide
tttaaatgcgaagtaaggcgggagcg

SEQ ID NO: 15 - DNA, 24 bp, Artificial
  Blocking oligonucleotide
gatatcttagcttgcctcgtcccc

SEQ ID NO: 16 - DNA, 26 bp, Artificial
  Blocking oligonucleotide
tttaaaatcccccctacgcaacgcaa

SEQ ID NO: 17 - DNA, 24 bp, Artificial
  Blocking oligonucleotide
gatacttttcgacactggatggcg

SEQ ID NO: 18 - DNA, 20 bp, Artificial
  20-mer unique DNA sequence
aacggctcagaccactgtcg

SEQ ID NO: 19 - DNA, 20 bp, Artificial
  20-mer unique DNA sequence
gaaaatgggagggagcgcgc

SEQ ID NO: 20 - DNA, 20 bp, Artificial
  20-mer unique DNA sequence
ctccgtggtcacaacccgaa

SEQ ID NO: 21 - DNA, 20 bp, Artificial
  20-mer unique DNA sequence
gtccgagagtcggcacgaat

SEQ ID NO: 22 - DNA, 20 bp, Artificial
  20-mer unique DNA sequence
tggaggttgaaaggggggct

SEQ ID NO: 23 - DNA, 20 bp, Artificial
  20-mer unique DNA sequence
caagatgctgccgggaaacg

SEQ ID NO: 24 - DNA, 20 bp, Artificial
  20-mer unique DNA sequence
acgcatagtgccctgagctg

SEQ ID NO: 25 - DNA, 20 bp, Artificial
  20-mer unique DNA sequence
gcgtgtagtgcagctgtgtc

SEQ ID NO: 26 - DNA, 20 bp, Artificial
  20-mer unique DNA sequence
tcaggcttgggatcgcggaa

SEQ ID NO: 27 - DNA, 20 bp, Artificial
  20-mer unique DNA sequence
gatgggccggcagcagataa

SEQ ID NO: 28 - DNA, 20 bp, Artificial
  20-mer unique DNA sequence
gcacggggggaactcacagc

SEQ ID NO: 29 - DNA, 20 bp, Artificial
  20-mer unique DNA sequence
tgtatgtcgggtggcgggta

SEQ ID NO: 30 - DNA, 20 bp, Artificial
  20-mer unique DNA sequence
ctctttcgtccgccgcttcc

SEQ ID NO: 31 - DNA, 20 bp, Artificial
  20-mer unique DNA sequence
cagggcgtgagtggggcaag

SEQ ID NO: 32 - DNA, 20 bp, Artificial
  20-mer unique DNA sequence
agatccgaggggaacccagc

SEQ ID NO: 33 - DNA, 20 bp, Artificial
  20-mer unique DNA sequence
ccaatgctgtaggcggggtc

SEQ ID NO: 34 - DNA, 20 bp, Artificial
  20-mer unique DNA sequence
gctggtccacaaaacgccct

SEQ ID NO: 35 - DNA, 20 bp, Artificial
  20-mer unique DNA sequence
cgttgcggtttattgctcgc

SEQ ID NO: 36 - DNA, 20 bp, Artificial
  20-mer unique DNA sequence
gttcctgcccgtctttcccc

SEQ ID NO: 37 - DNA, 20 bp, Artificial
  20-mer unique DNA sequence
ttctgagcttgacggggcgc

SEQ ID NO: 38 - DNA, 20 bp, Artificial
  20-mer unique DNA sequence
tatctgcgctaggggtcgcc

SEQ ID NO: 39 - DNA, 20 bp, Artificial
  20-mer unique DNA sequence
tgccccgtcgcttccttacc

SEQ ID NO: 40 - DNA, 20 bp, Artificial
  20-mer unique DNA sequence
gtctgtgctgtgtgcgcggg

SEQ ID NO: 41 - DNA, 20 bp, Artificial
  20-mer unique DNA sequence
tctctcggcattgggggggt

SEQ ID NO: 42 - DNA, 20 bp, Artificial
  20-mer unique DNA sequence
cgtacaccgccgcaaacaag

SEQ ID NO: 43 - DNA, 20 bp, Artificial
  20-mer unique DNA sequence
cccacaaacaacggcacgga

SEQ ID NO: 44 - DNA, 20 bp, Artificial
  20-mer unique DNA sequence
gctcgggggtagggtggaca

SEQ ID NO: 45 - DNA, 20 bp, Artificial
  20-mer unique DNA sequence
cacccttcgctgcccattga

SEQ ID NO: 46 - DNA, 20 bp, Artificial
  20-mer unique DNA sequence
cgttcgatgtgggggttttt

SEQ ID NO: 47 - DNA, 20 bp, Artificial
  20-mer unique DNA sequence
cgagcccaatgcatagcccc

SEQ ID NO: 48 - DNA, 20 bp, Artificial
  20-mer unique DNA sequence
ggtggcattggggctttcga

SEQ ID NO: 49 - DNA, 20 bp, Artificial
  20-mer unique DNA sequence
tccatcgcgaaacacagcct

SEQ ID NO: 50 - DNA, 20 bp, Artificial
  20-mer unique DNA sequence
ccgaaaaccgacccaacacc

SEQ ID NO: 51 - DNA, 20 bp, Artificial
  20-mer unique DNA sequence
cggagggtacgccaatggaa

SEQ ID NO: 52 - DNA, 20 bp, Artificial
  20-mer unique DNA sequence
cccgtctgctcgccactttg

SEQ ID NO: 53 - DNA, 20 bp, Artificial
  20-mer unique DNA sequence
gagcgggtcgggagaggttt

SEQ ID NO: 54 - DNA, 20 bp, Artificial
  20-mer unique DNA sequence
ccccaagacaacgcgccaac

SEQ ID NO: 55 - DNA, 20 bp, Artificial
  20-mer unique DNA sequence
ttgggcgacggctagcatct

SEQ ID NO: 56 - DNA, 20 bp, Artificial
  20-mer unique DNA sequence
acggctcgatgaaacccctg

SEQ ID NO: 57 - DNA, 20 bp, Artificial
  20-mer unique DNA sequence
gctctccatcgacgttccgc

SEQ ID NO: 58 - DNA, 20 bp, Artificial
  20-mer unique DNA sequence
ggttgtgcagcgagggcgtt

SEQ ID NO: 59 - DNA, 20 bp, Artificial
  20-mer unique DNA sequence
accccgacccgaaagccatc

SEQ ID NO: 60 - DNA, 20 bp, Artificial
  20-mer unique DNA sequence
tcccccgtggctcttcgttt

SEQ ID NO: 61 - DNA, 20 bp, Artificial
  20-mer unique DNA sequence
gtttcagtcaagtcgggggc

SEQ ID NO: 62 - DNA, 20 bp, Artificial
  20-mer unique DNA sequence
ataccagacccgtttcgccg

SEQ ID NO: 63 - DNA, 20 bp, Artificial
  20-mer unique DNA sequence
agtcgcgtagggggcgggtc

SEQ ID NO: 64 - DNA, 20 bp, Artificial
  20-mer unique DNA sequence
aggaggataacggcacggga

SEQ ID NO: 65 - DNA, 20 bp, Artificial
  20-mer unique DNA sequence
actgggggtggttaatggcg

SEQ ID NO: 66 - DNA, 20 bp, Artificial
  20-mer unique DNA sequence
tcggaaccccaaggcaaaca

SEQ ID NO: 67 - DNA, 20 bp, Artificial
  20-mer unique DNA sequence
gccggcctaacgctatccca

SEQ ID NO: 68 - DNA, 20 bp, Artificial
  20-mer unique DNA sequence
ccaccgccgcatatgttccc

SEQ ID NO: 69 - DNA, 20 bp, Artificial
  20-mer unique DNA sequence
gcctcccgaccatgcacttt

SEQ ID NO: 70 - DNA, 20 bp, Artificial
  20-mer unique DNA sequence
accagtgaaacgaagccgcg

SEQ ID NO: 71 - DNA, 20 bp, Artificial
  20-mer unique DNA sequence
cacaactcgaccccccgctt

SEQ ID NO: 72 - DNA, 20 bp, Artificial
  20-mer unique DNA sequence
aagttgcggcctagtggcct

SEQ ID NO: 73 - DNA, 20 bp, Artificial
  20-mer unique DNA sequence
gacggtgtgggggcgaaggt

SEQ ID NO: 74 - DNA, 20 bp, Artificial
  20-mer unique DNA sequence
gggggcgggcatcgattata

SEQ ID NO: 75 - DNA, 20 bp, Artificial
  20-mer unique DNA sequence
ttgcggggctgtcggtgata

SEQ ID NO: 76 - DNA, 20 bp, Artificial
  20-mer unique DNA sequence
atgcaggtggagggaacggg

SEQ ID NO: 77 - DNA, 20 bp, Artificial
  20-mer unique DNA sequence
cgtaactttgtgcccgcgtg

SEQ ID NO: 78 - DNA, 20 bp, Artificial
  20-mer unique DNA sequence
gaatggcagtggcgggaagc

SEQ ID NO: 79 - DNA, 20 bp, Artificial
  20-mer unique DNA sequence
cgggacgacaagggaggaga

SEQ ID NO: 80 - DNA, 20 bp, Artificial
  20-mer unique DNA sequence
cgtccctgcgcaataagctg

SEQ ID NO: 81 - DNA, 20 bp, Artificial
  20-mer unique DNA sequence
ccaggtcccgctcacttccc

SEQ ID NO: 82 - DNA, 20 bp, Artificial
  20-mer unique DNA sequence
cttccaccgacggaccaaca

SEQ ID NO: 83 - DNA, 20 bp, Artificial
  20-mer unique DNA sequence
tttttatggccgggatcgcg

SEQ ID NO: 84 - DNA, 20 bp, Artificial
  20-mer unique DNA sequence
cgcgtggtcttgtcggtgaa

SEQ ID NO: 85 - DNA, 20 bp, Artificial
  20-mer unique DNA sequence
cgatcccctaccagccccgt

SEQ ID NO: 86 - DNA, 20 bp, Artificial
  20-mer unique DNA sequence
cctcacggcatgtgcgtgtt

SEQ ID NO: 87 - DNA, 20 bp, Artificial
  20-mer unique DNA sequence
gcccacgtagcggataacct

SEQ ID NO: 88 - DNA, 20 bp, Artificial
  20-mer unique DNA sequence
tccccgacgcacacgaagat

SEQ ID NO: 89 - DNA, 20 bp, Artificial
  20-mer unique DNA sequence
ccgcaaacaggaggcaatcg

SEQ ID NO: 90 - DNA, 20 bp, Artificial
  20-mer unique DNA sequence
tgtcgacggactcctcacga

SEQ ID NO: 91 - DNA, 20 bp, Artificial
  20-mer unique DNA sequence
ctccgtaatcggcgcgaatg

SEQ ID NO: 92 - DNA, 20 bp, Artificial
  20-mer unique DNA sequence
tgtcgagtgggcgcgttatc

SEQ ID NO: 93 - DNA, 20 bp, Artificial
  20-mer unique DNA sequence
tctgtcataaccgccgccga

SEQ ID NO: 94 - DNA, 20 bp, Artificial
  20-mer unique DNA sequence
acgacgcggtagtaacccct

SEQ ID NO: 95 - DNA, 20 bp, Artificial
  20-mer unique DNA sequence
tgagtccggtcgataggggt

SEQ ID NO: 96 - DNA, 20 bp, Artificial
  20-mer unique DNA sequence
agcggaaggaagagggagcc

SEQ ID NO: 97 - DNA, 20 bp, Artificial
  20-mer unique DNA sequence
gggtgtttgtcggggggcac

SEQ ID NO: 98 - DNA, 20 bp, Artificial
  20-mer unique DNA sequence
tccgcctctgcccacctgac

SEQ ID NO: 99 - DNA, 20 bp, Artificial
  20-mer unique DNA sequence
gacggttgcaaggtggctgg

SEQ ID NO: 100 - DNA, 20 bp, Artificial
  20-mer unique DNA sequence
aggggatccagtgcggcttt

SEQ ID NO: 101 - DNA, 20 bp, Artificial
  20-mer unique DNA sequence
catccccgtacccacccctg

SEQ ID NO: 102 - DNA, 20 bp, Artificial
  20-mer unique DNA sequence
gggatttcgacgtggttgca

SEQ ID NO: 103 - DNA, 20 bp, Artificial
  20-mer unique DNA sequence
gccctaccagattgccagcg

SEQ ID NO: 104 - DNA, 20 bp, Artificial
  20-mer unique DNA sequence
cgacgtcacgccgatcctta

SEQ ID NO: 105 - DNA, 20 bp, Artificial
  20-mer unique DNA sequence
gacgagtgtgaccgtgcaga

SEQ ID NO: 106 - DNA, 20 bp, Artificial
  20-mer unique DNA sequence
tgacataatcgaggggcggg

SEQ ID NO: 107 - DNA, 20 bp, Artificial
  20-mer unique DNA sequence
aaactgccgatgcctgaccg

SEQ ID NO: 108 - DNA, 20 bp, Artificial
  20-mer unique DNA sequence
tgcggcggaatcagttaggg

SEQ ID NO: 109 - DNA, 20 bp, Artificial
  20-mer unique DNA sequence
cgtatgcgagctcggaaggt

SEQ ID NO: 110 - DNA, 20 bp, Artificial
  20-mer unique DNA sequence
cacggggcaatggagagacg

SEQ ID NO: 111 - DNA, 20 bp, Artificial
  20-mer unique DNA sequence
tgagcgcggagggaagaagg

SEQ ID NO: 112 - DNA, 20 bp, Artificial
  20-mer unique DNA sequence
gtgttgttcatgggcgcgga

SEQ ID NO: 113 - DNA, 20 bp, Artificial
  20-mer unique DNA sequence
gctgtgtgagctgacgccat

SEQ ID NO: 114 - DNA, 20 bp, Artificial
  20-mer unique DNA sequence
acgcgagggttcaaggcaga

SEQ ID NO: 115 - DNA, 20 bp, Artificial
  20-mer unique DNA sequence
gaacgaaaccgatcgcgctc

SEQ ID NO: 116 - DNA, 20 bp, Artificial
  20-mer unique DNA sequence
agtaccgagggaggcgcgaa

SEQ ID NO: 117 - DNA, 20 bp, Artificial
  20-mer unique DNA sequence
gggggggagtgtgaacgcag

SEQ ID NO: 118 - DNA, 20 bp, Artificial
  20-mer unique DNA sequence
tgcgagagtgccgacgtgat

SEQ ID NO: 119 - DNA, 20 bp, Artificial
  20-mer unique DNA sequence
aatgcgctgacaggtctcgc

SEQ ID NO: 120 - DNA, 20 bp, Artificial
  20-mer unique DNA sequence
tggtgagcaggcagcgattt

SEQ ID NO: 121 - DNA, 20 bp, Artificial
  20-mer unique DNA sequence
tgcgtgaacacgggccagat

SEQ ID NO: 122 - DNA, 20 bp, Artificial
  20-mer unique DNA sequence
cggattgttgaacggtgggg

SEQ ID NO: 123 - DNA, 20 bp, Artificial
  20-mer unique DNA sequence
tgcgtgtctcgctcggttct

SEQ ID NO: 124 - DNA, 20 bp, Artificial
  20-mer unique DNA sequence
cacccaagcttcgccacacc

SEQ ID NO: 125 - DNA, 20 bp, Artificial
  20-mer unique DNA sequence
cctctccttccgcgcctctt

SEQ ID NO: 126 - DNA, 20 bp, Artificial
  20-mer unique DNA sequence
gggaaccagcggggcgatag

SEQ ID NO: 127 - DNA, 20 bp, Artificial
  20-mer unique DNA sequence
acttgcttccgggttcgatg

SEQ ID NO: 128 - DNA, 20 bp, Artificial
  20-mer unique DNA sequence
ccgtgtgcgaagccagaaaa

SEQ ID NO: 129 - DNA, 20 bp, Artificial
  20-mer unique DNA sequence
gcgcctctgccactcccaac

SEQ ID NO: 130 - DNA, 20 bp, Artificial
  20-mer unique DNA sequence
gggcaaaaggacgtgggtgg

SEQ ID NO: 131 - DNA, 20 bp, Artificial
  20-mer unique DNA sequence
gctatcggttttgggcggga

SEQ ID NO: 132 - DNA, 20 bp, Artificial
  20-mer unique DNA sequence
gggcgagtcgaacctcatct

SEQ ID NO: 133 - DNA, 20 bp, Artificial
  20-mer unique DNA sequence
tgcggctcactgggggatta

SEQ ID NO: 134 - DNA, 20 bp, Artificial
  20-mer unique DNA sequence
tactccgttccccacccgct

SEQ ID NO: 135 - DNA, 20 bp, Artificial
  20-mer unique DNA sequence
ttagggtcggggggtcggag

SEQ ID NO: 136 - DNA, 20 bp, Artificial
  20-mer unique DNA sequence
atgtgggccgggctgaacgc

SEQ ID NO: 137 - DNA, 20 bp, Artificial
  20-mer unique DNA sequence
actccccacactccgcccta

SEQ ID NO: 138 - DNA, 20 bp, Artificial
  20-mer unique DNA sequence
tgggatggaaattgcagggc

SEQ ID NO: 139 - DNA, 20 bp, Artificial
  20-mer unique DNA sequence
tattgcgggccttgcggtgt

SEQ ID NO: 140 - DNA, 20 bp, Artificial
  20-mer unique DNA sequence
tggaggcaggtaggggtgga

SEQ ID NO: 141 - DNA, 20 bp, Artificial
  20-mer unique DNA sequence
acttgttgttggcagcgcgg

SEQ ID NO: 142 - DNA, 20 bp, Artificial
  20-mer unique DNA sequence
tccggatctgtgcagccagt

SEQ ID NO: 143 - DNA, 20 bp, Artificial
  20-mer unique DNA sequence
tggctagagtacgccggaac

SEQ ID NO: 144 - DNA, 20 bp, Artificial
  20-mer unique DNA sequence
tctaccgccacgctccccat

SEQ ID NO: 145 - DNA, 20 bp, Artificial
  20-mer unique DNA sequence
gccgcctcttgactcgcttg

SEQ ID NO: 146 - DNA, 20 bp, Artificial
  20-mer unique DNA sequence
gggggggatgccgcttaaga

SEQ ID NO: 147 - DNA, 20 bp, Artificial
  20-mer unique DNA sequence
ccgcgggttcttctggcttg

SEQ ID NO: 148 - DNA, 20 bp, Artificial
  20-mer unique DNA sequence
gggctagcgtttggggatcg

SEQ ID NO: 149 - DNA, 20 bp, Artificial
  20-mer unique DNA sequence
cgacataccacgcgcaatcc

SEQ ID NO: 150 - DNA, 20 bp, Artificial
  20-mer unique DNA sequence
tttttctatcacgccgcccc

SEQ ID NO: 151 - DNA, 20 bp, Artificial
  20-mer unique DNA sequence
cagcaacatttcacgcccgc

SEQ ID NO: 152 - DNA, 20 bp, Artificial
  20-mer unique DNA sequence
tgacacgcttagtccgcgcc

SEQ ID NO: 153 - DNA, 20 bp, Artificial
  20-mer unique DNA sequence
atccgcgtaaggcgtcaccc

SEQ ID NO: 154 - DNA, 20 bp, Artificial
  20-mer unique DNA sequence
tcgcattgttgccctccctt

SEQ ID NO: 155 - DNA, 20 bp, Artificial
  20-mer unique DNA sequence
acaaaggtggcgaacggggc

SEQ ID NO: 156 - DNA, 20 bp, Artificial
  20-mer unique DNA sequence
ttgggcgtttgggcggtacg

SEQ ID NO: 157 - DNA, 20 bp, Artificial
  20-mer unique DNA sequence
gggcgcagtcggaaataacc

SEQ ID NO: 158 - DNA, 20 bp, Artificial
  20-mer unique DNA sequence
tcgggcgtgcggacaaagag

SEQ ID NO: 159 - DNA, 20 bp, Artificial
  20-mer unique DNA sequence
cccccccgtaccgctgaaaa

SEQ ID NO: 160 - DNA, 20 bp, Artificial
  20-mer unique DNA sequence
tcgacagcaggacagcacgg

SEQ ID NO: 161 - DNA, 20 bp, Artificial
  20-mer unique DNA sequence
cgctttgccgaggttttggg

SEQ ID NO: 162 - DNA, 20 bp, Artificial
  20-mer unique DNA sequence
tcacgactaccccgccaatg

SEQ ID NO: 163 - DNA, 20 bp, Artificial
  20-mer unique DNA sequence
atacactccgcccccctcgt

SEQ ID NO: 164 - DNA, 20 bp, Artificial
  20-mer unique DNA sequence
tctcccccatacccccgcaa

SEQ ID NO: 165 - DNA, 20 bp, Artificial
  20-mer unique DNA sequence
catcgggggatacgcttagg

SEQ ID NO: 166 - DNA, 20 bp, Artificial
  20-mer unique DNA sequence
tgtaactcggtcgcgctggc

SEQ ID NO: 167 - DNA, 20 bp, Artificial
  20-mer unique DNA sequence
ttgtgcggcgtgttcgtgat

SEQ ID NO: 168 - DNA, 20 bp, Artificial
  20-mer unique DNA sequence
tgggtgatatggcgtccgat

SEQ ID NO: 169 - DNA, 20 bp, Artificial
  20-mer unique DNA sequence
ccaggcacgcgcaattatga

SEQ ID NO: 170 - DNA, 20 bp, Artificial
  20-mer unique DNA sequence
ttattcccctgagcgccacc

SEQ ID NO: 171 - DNA, 20 bp, Artificial
  20-mer unique DNA sequence
gaggaagggaaggcggggtc

SEQ ID NO: 172 - DNA, 20 bp, Artificial
  20-mer unique DNA sequence
tagaagcatgaccaccgcgc

SEQ ID NO: 173 - DNA, 20 bp, Artificial
  20-mer unique DNA sequence
tcctaatcccctcacgctct

SEQ ID NO: 174 - DNA, 20 bp, Artificial
  20-mer unique DNA sequence
ctccctcatccccagccacg

SEQ ID NO: 175 - DNA, 20 bp, Artificial
  20-mer unique DNA sequence
tggaaaagccgagggacgcc

SEQ ID NO: 176 - DNA, 20 bp, Artificial
  20-mer unique DNA sequence
tgggttgcgcctggtatgcc

SEQ ID NO: 177 - DNA, 20 bp, Artificial
  20-mer unique DNA sequence
gggggacgcttattggcaag

SEQ ID NO: 178 - DNA, 20 bp, Artificial
  20-mer unique DNA sequence
actcccgccttcgccacttg

SEQ ID NO: 179 - DNA, 20 bp, Artificial
  20-mer unique DNA sequence
caataggcacccgcagacgc

SEQ ID NO: 180 - DNA, 20 bp, Artificial
  20-mer unique DNA sequence
ggtgtccaagggcgcaagtg

SEQ ID NO: 181 - DNA, 20 bp, Artificial
  20-mer unique DNA sequence
ttccccgcacaccaggctac

SEQ ID NO: 182 - DNA, 20 bp, Artificial
  20-mer unique DNA sequence
aattgtcccgcccagcctct

SEQ ID NO: 183 - DNA, 20 bp, Artificial
  20-mer unique DNA sequence
tcggccaacggataaacgca

SEQ ID NO: 184 - DNA, 20 bp, Artificial
  20-mer unique DNA sequence
aggaagccaagcccgcgtac

SEQ ID NO: 185 - DNA, 20 bp, Artificial
  20-mer unique DNA sequence
gtacgcttaatctctcgccc

SEQ ID NO: 186 - DNA, 20 bp, Artificial
  20-mer unique DNA sequence
gtcgtactcggcctttgcgc

SEQ ID NO: 187 - DNA, 20 bp, Artificial
  20-mer unique DNA sequence
aaaggcgggcggtgaaaaga

SEQ ID NO: 188 - DNA, 20 bp, Artificial
  20-mer unique DNA sequence
attgcgacgggacggaggta

SEQ ID NO: 189 - DNA, 20 bp, Artificial
  20-mer unique DNA sequence
tcgcgccgggtgaataagct

SEQ ID NO: 190 - DNA, 20 bp, Artificial
  20-mer unique DNA sequence
gctgcgggctgtgtttgtca

SEQ ID NO: 191 - DNA, 20 bp, Artificial
  20-mer unique DNA sequence
gtacacgcttcaccatcgca

SEQ ID NO: 192 - DNA, 20 bp, Artificial
  20-mer unique DNA sequence
ccgcccctgcttaccttcca

SEQ ID NO: 193 - DNA, 20 bp, Artificial
  20-mer unique DNA sequence
gggtcatagcgatcggcggt

SEQ ID NO: 194 - DNA, 20 bp, Artificial
  20-mer unique DNA sequence
ggactaagcggggcggattt

SEQ ID NO: 195 - DNA, 20 bp, Artificial
  20-mer unique DNA sequence
gtccgttgcttgtgggtgcg

SEQ ID NO: 196 - DNA, 20 bp, Artificial
  20-mer unique DNA sequence
actcttcgttcgctgccccc

SEQ ID NO: 197 - DNA, 20 bp, Artificial
  20-mer unique DNA sequence
aagggtggaaacggtgggga

SEQ ID NO: 198 - DNA, 20 bp, Artificial
  20-mer unique DNA sequence
cctcggacccctaaccccct

SEQ ID NO: 199 - DNA, 20 bp, Artificial
  20-mer unique DNA sequence
gagggaacgccggtgaggat

SEQ ID NO: 200 - DNA, 20 bp, Artificial
  20-mer unique DNA sequence
gcgggaacttggtggggtga

SEQ ID NO: 201 - DNA, 20 bp, Artificial
  20-mer unique DNA sequence
cgcggaggggaacagccatt

SEQ ID NO: 202 - DNA, 20 bp, Artificial
  20-mer unique DNA sequence
gaccctcggaacctgctcgc

SEQ ID NO: 203 - DNA, 20 bp, Artificial
  20-mer unique DNA sequence
accgaggcgtcattcccagc

SEQ ID NO: 204 - DNA, 20 bp, Artificial
  20-mer unique DNA sequence
ataagcatcgagcgggcgga

SEQ ID NO: 205 - DNA, 20 bp, Artificial
  20-mer unique DNA sequence
ccgaccattccccttcagcc

SEQ ID NO: 206 - DNA, 20 bp, Artificial
  20-mer unique DNA sequence
acgggtaacacttgcgggag

SEQ ID NO: 207 - DNA, 20 bp, Artificial
  20-mer unique DNA sequence
tctggtcggtccttggctca

SEQ ID NO: 208 - DNA, 20 bp, Artificial
  20-mer unique DNA sequence
aacccccacaactagccgcc

SEQ ID NO: 209 - DNA, 20 bp, Artificial
  20-mer unique DNA sequence
cgttgcctgcagtgctctct

SEQ ID NO: 210 - DNA, 20 bp, Artificial
  20-mer unique DNA sequence
actgggctaggacggtctga

SEQ ID NO: 211 - DNA, 20 bp, Artificial
  20-mer unique DNA sequence
agccacggtgtgaccgctaa

SEQ ID NO: 212 - DNA, 20 bp, Artificial
  20-mer unique DNA sequence
gccggccattattccctctg

SEQ ID NO: 213 - DNA, 20 bp, Artificial
  20-mer unique DNA sequence
gcagtccccctctctcccct

SEQ ID NO: 214 - DNA, 20 bp, Artificial
  20-mer unique DNA sequence
atcacgcactatgcgctggg

SEQ ID NO: 215 - DNA, 20 bp, Artificial
  20-mer unique DNA sequence
gaggtcagagccgatgcgta

SEQ ID NO: 216 - DNA, 20 bp, Artificial
  20-mer unique DNA sequence
agggttggctgcgagtggtc

SEQ ID NO: 217 - DNA, 20 bp, Artificial
  20-mer unique DNA sequence
agagtgtttccccccccggc

SEQ ID NO: 218 - DNA, 20 bp, Artificial
  20-mer unique DNA sequence
tggttatgttgccggggtgc

SEQ ID NO: 219 - DNA, 20 bp, Artificial
  20-mer unique DNA sequence
ggggctcagtcaaggcgtct

SEQ ID NO: 220 - DNA, 20 bp, Artificial
  20-mer unique DNA sequence
agatcggaatggagcggggc

SEQ ID NO: 221 - DNA, 20 bp, Artificial
  20-mer unique DNA sequence
aacgcgccaacgaggaaccc

SEQ ID NO: 222 - DNA, 20 bp, Artificial
  20-mer unique DNA sequence
ccggtctggggaatttggca

SEQ ID NO: 223 - DNA, 20 bp, Artificial
  20-mer unique DNA sequence
ctgcggaaactgggctgggt

SEQ ID NO: 224 - DNA, 20 bp, Artificial
  20-mer unique DNA sequence
ctcacaaacccccccaatcg

SEQ ID NO: 225 - DNA, 20 bp, Artificial
  20-mer unique DNA sequence
gatctactgccgcttcccgc

SEQ ID NO: 226 - DNA, 20 bp, Artificial
  20-mer unique DNA sequence
tggaagtacaggcgcaggat

SEQ ID NO: 227 - DNA, 20 bp, Artificial
  20-mer unique DNA sequence
ccggcgcgtgtgtagttgga

SEQ ID NO: 228 - DNA, 20 bp, Artificial
  20-mer unique DNA sequence
aacctgccttccgcccctaa

SEQ ID NO: 229 - DNA, 20 bp, Artificial
  20-mer unique DNA sequence
tctttgtctgctttcccgca

SEQ ID NO: 230 - DNA, 20 bp, Artificial
  20-mer unique DNA sequence
tcgggtggcggttcgtaggt

SEQ ID NO: 231 - DNA, 20 bp, Artificial
  20-mer unique DNA sequence
cagaatccaccacggcctcg

SEQ ID NO: 232 - DNA, 20 bp, Artificial
  20-mer unique DNA sequence
cggctggcgtgcgaactgat

SEQ ID NO: 233 - DNA, 20 bp, Artificial
  20-mer unique DNA sequence
cccgctcgtcgctttgcaac

SEQ ID NO: 234 - DNA, 20 bp, Artificial
  20-mer unique DNA sequence
tagtccggcgcaaacgtggg

SEQ ID NO: 235 - DNA, 20 bp, Artificial
  20-mer unique DNA sequence
cggggatgttcgtaggcaag

SEQ ID NO: 236 - DNA, 20 bp, Artificial
  20-mer unique DNA sequence
ggaaggggctttgcgtgggt

SEQ ID NO: 237 - DNA, 20 bp, Artificial
  20-mer unique DNA sequence
gattggggtgcgcttgaaca

SEQ ID NO: 238 - DNA, 20 bp, Artificial
  20-mer unique DNA sequence
tgcttagctcctggctacgg

SEQ ID NO: 239 - DNA, 20 bp, Artificial
  20-mer unique DNA sequence
ctgtccaccccttcaccccc

SEQ ID NO: 240 - DNA, 20 bp, Artificial
  20-mer unique DNA sequence
caccgccccccactagaagg

SEQ ID NO: 241 - DNA, 20 bp, Artificial
  20-mer unique DNA sequence
ctgggcggctgaaggtgagt

SEQ ID NO: 242 - DNA, 20 bp, Artificial
  20-mer unique DNA sequence
gaacagccaacggtcacgcc

SEQ ID NO: 243 - DNA, 20 bp, Artificial
  20-mer unique DNA sequence
atcgtctgtgcctgctcccg

SEQ ID NO: 244 - DNA, 20 bp, Artificial
  20-mer unique DNA sequence
ggacgggtcgaacaacgtga

SEQ ID NO: 245 - DNA, 20 bp, Artificial
  20-mer unique DNA sequence
aactactggcgcctctgtgc

SEQ ID NO: 246 - DNA, 20 bp, Artificial
  20-mer unique DNA sequence
tcgtagccgttgggggtgtt

SEQ ID NO: 247 - DNA, 20 bp, Artificial
  20-mer unique DNA sequence
cgtccgccccctgaactctt

SEQ ID NO: 248 - DNA, 20 bp, Artificial
  20-mer unique DNA sequence
ctccggcctcagctttctcg

SEQ ID NO: 249 - DNA, 20 bp, Artificial
  20-mer unique DNA sequence
caaaccaaccctgcgaccaa

SEQ ID NO: 250 - DNA, 20 bp, Artificial
  20-mer unique DNA sequence
cctttccccggtgttcccct

SEQ ID NO: 251 - DNA, 20 bp, Artificial
  20-mer unique DNA sequence
agattgcaacccgaaggcgc

SEQ ID NO: 252 - DNA, 20 bp, Artificial
  20-mer unique DNA sequence
attcgcaacgcagctaccca

SEQ ID NO: 253 - DNA, 20 bp, Artificial
  20-mer unique DNA sequence
gatcttcacagggggccgca

SEQ ID NO: 254 - DNA, 20 bp, Artificial
  20-mer unique DNA sequence
gtccacccggcttctccatc

SEQ ID NO: 255 - DNA, 20 bp, Artificial
  20-mer unique DNA sequence
tcagctcccccgtcccttta

SEQ ID NO: 256 - DNA, 20 bp, Artificial
  20-mer unique DNA sequence
agcacgcgagggaggacaag

SEQ ID NO: 257 - DNA, 20 bp, Artificial
  20-mer unique DNA sequence
gtgtaaccatggggagcgcc

SEQ ID NO: 258 - DNA, 20 bp, Artificial
  20-mer unique DNA sequence
tctaccccccgcgcatctta

SEQ ID NO: 259 - DNA, 20 bp, Artificial
  20-mer unique DNA sequence
ttaatggggcaagtggcggt

SEQ ID NO: 260 - DNA, 20 bp, Artificial
  20-mer unique DNA sequence
aagaccacccccccaggacc

SEQ ID NO: 261 - DNA, 20 bp, Artificial
  20-mer unique DNA sequence
tccctcctgtaactcccgcc

SEQ ID NO: 262 - DNA, 20 bp, Artificial
  20-mer unique DNA sequence
taagcaaaacgcccaccggt

SEQ ID NO: 263 - DNA, 20 bp, Artificial
  20-mer unique DNA sequence
gaaggcccgtaaccccgaac

SEQ ID NO: 264 - DNA, 20 bp, Artificial
  20-mer unique DNA sequence
caaccccacacagccccacg

SEQ ID NO: 265 - DNA, 20 bp, Artificial
  20-mer unique DNA sequence
tgggacggctgttgagggaa

SEQ ID NO: 266 - DNA, 20 bp, Artificial
  20-mer unique DNA sequence
aaagctgctacgcccgaccc

SEQ ID NO: 267 - DNA, 20 bp, Artificial
  20-mer unique DNA sequence
accagcgcccagatgaaagg

SEQ ID NO: 268 - DNA, 20 bp, Artificial
  20-mer unique DNA sequence
gcgaggagcggatgagagga

SEQ ID NO: 269 - DNA, 20 bp, Artificial
  20-mer unique DNA sequence
gggggttcggccttgtagct

SEQ ID NO: 270 - DNA, 20 bp, Artificial
  20-mer unique DNA sequence
tccgccgtgcctgctaagta

SEQ ID NO: 271 - DNA, 20 bp, Artificial
  20-mer unique DNA sequence
aagactgagggagacgcggc

SEQ ID NO: 272 - DNA, 20 bp, Artificial
  20-mer unique DNA sequence
tggagtggcggcgtgtacct

SEQ ID NO: 273 - DNA, 20 bp, Artificial
  20-mer unique DNA sequence
tggggcgccgtgtattaggt

SEQ ID NO: 274 - DNA, 20 bp, Artificial
  20-mer unique DNA sequence
ttgtagcagtcgatgccggc

SEQ ID NO: 275 - DNA, 20 bp, Artificial
  20-mer unique DNA sequence
ccgagggtcgtggttgggat

SEQ ID NO: 276 - DNA, 20 bp, Artificial
  20-mer unique DNA sequence
ttaggagccgaccaatgggc

SEQ ID NO: 277 - DNA, 20 bp, Artificial
  20-mer unique DNA sequence
gggggtactcggtcgctttg

SEQ ID NO: 278 - DNA, 20 bp, Artificial
  20-mer unique DNA sequence
tcacggtgggacgggttagc

SEQ ID NO: 279 - DNA, 20 bp, Artificial
  20-mer unique DNA sequence
atcgggcggggcaattagag

SEQ ID NO: 280 - DNA, 20 bp, Artificial
  20-mer unique DNA sequence
catatgggaagggcgcgtgc

SEQ ID NO: 281 - DNA, 20 bp, Artificial
  20-mer unique DNA sequence
tcacgttgcgggttttcggc

SEQ ID NO: 282 - DNA, 20 bp, Artificial
  20-mer unique DNA sequence
tggctattcgaggctggggt

SEQ ID NO: 283 - DNA, 20 bp, Artificial
  20-mer unique DNA sequence
atggcagagcgggcagggta

SEQ ID NO: 284 - DNA, 20 bp, Artificial
  20-mer unique DNA sequence
caggtggtgcgacgagggtg

SEQ ID NO: 285 - DNA, 20 bp, Artificial
  20-mer unique DNA sequence
accccaccgcacctgtctcc

SEQ ID NO: 286 - DNA, 20 bp, Artificial
  20-mer unique DNA sequence
ctgcggtcgggatttaaggc

SEQ ID NO: 287 - DNA, 20 bp, Artificial
  20-mer unique DNA sequence
tgaaggtgttagcgggcggc

SEQ ID NO: 288 - DNA, 20 bp, Artificial
  20-mer unique DNA sequence
ctttggggcttgcggactca

SEQ ID NO: 289 - DNA, 20 bp, Artificial
  20-mer unique DNA sequence
cgcccccgaaggtaactgcc

SEQ ID NO: 290 - DNA, 20 bp, Artificial
  20-mer unique DNA sequence
gtaagggcgcggtgatcgtg

SEQ ID NO: 291 - DNA, 20 bp, Artificial
  20-mer unique DNA sequence
tttccacgttccgccttttg

SEQ ID NO: 292 - DNA, 20 bp, Artificial
  20-mer unique DNA sequence
ttcgccgctccctcgtgtgt

SEQ ID NO: 293 - DNA, 20 bp, Artificial
  20-mer unique DNA sequence
gttgaaatgcggggaggagg

SEQ ID NO: 294 - DNA, 20 bp, Artificial
  20-mer unique DNA sequence
acgtgcgtgacataggggtg

SEQ ID NO: 295 - DNA, 20 bp, Artificial
  20-mer unique DNA sequence
tcgtggctccctagtaccca

SEQ ID NO: 296 - DNA, 20 bp, Artificial
  20-mer unique DNA sequence
gattgcggggggtttagtgg

SEQ ID NO: 297 - DNA, 20 bp, Artificial
  20-mer unique DNA sequence
ccctcgttctcccatctccg

SEQ ID NO: 298 - DNA, 20 bp, Artificial
  20-mer unique DNA sequence
ccatgagcacgttttcgcga

SEQ ID NO: 299 - DNA, 20 bp, Artificial
  20-mer unique DNA sequence
gctgttttgtggccatccga

SEQ ID NO: 300 - DNA, 20 bp, Artificial
  20-mer unique DNA sequence
aatcacagaatgggggccgt

SEQ ID NO: 301 - DNA, 20 bp, Artificial
  20-mer unique DNA sequence
tgcaccctcgcccagaatcc

SEQ ID NO: 302 - DNA, 20 bp, Artificial
  20-mer unique DNA sequence
aagacgcactaagccggggg

SEQ ID NO: 303 - DNA, 20 bp, Artificial
  20-mer unique DNA sequence
gagacaagaccggcaacgcc

SEQ ID NO: 304 - DNA, 20 bp, Artificial
  20-mer unique DNA sequence
gttgccgtggggtcgggtta

SEQ ID NO: 305 - DNA, 20 bp, Artificial
  20-mer unique DNA sequence
tgtcgctgttccccgtccag

SEQ ID NO: 306 - DNA, 20 bp, Artificial
  20-mer unique DNA sequence
gctggaaatgttggggctgc

SEQ ID NO: 307 - DNA, 20 bp, Artificial
  20-mer unique DNA sequence
ctctgtgtccccttcgccgc

SEQ ID NO: 308 - DNA, 20 bp, Artificial
  20-mer unique DNA sequence
cccgcccaatgcaatcgttt

SEQ ID NO: 309 - DNA, 20 bp, Artificial
  20-mer unique DNA sequence
aagcgcccaaaactgccccg

SEQ ID NO: 310 - DNA, 20 bp, Artificial
  20-mer unique DNA sequence
cagctgtcggttaaattgcg

SEQ ID NO: 311 - DNA, 20 bp, Artificial
  20-mer unique DNA sequence
atgcccacttcccggttcgt

SEQ ID NO: 312 - DNA, 20 bp, Artificial
  20-mer unique DNA sequence
acaattgcgcctcctcgtgc

SEQ ID NO: 313 - DNA, 20 bp, Artificial
  20-mer unique DNA sequence
tcgcctctgctcacgtctcg

SEQ ID NO: 314 - DNA, 20 bp, Artificial
  20-mer unique DNA sequence
gggaaatcagcaaagccggc

SEQ ID NO: 315 - DNA, 20 bp, Artificial
  20-mer unique DNA sequence
catctcaccaccgcgcaaat

SEQ ID NO: 316 - DNA, 20 bp, Artificial
  20-mer unique DNA sequence
caggcgggggtggaaaatcg

SEQ ID NO: 317 - DNA, 20 bp, Artificial
  20-mer unique DNA sequence
ctttcgaaccccaaaacccg

SEQ ID NO: 318 - DNA, 20 bp, Artificial
  20-mer unique DNA sequence
tccgcgggaaaaacagaacg

SEQ ID NO: 319 - DNA, 20 bp, Artificial
  20-mer unique DNA sequence
atccctccagtgccagtcgc

SEQ ID NO: 320 - DNA, 20 bp, Artificial
  20-mer unique DNA sequence
tctgttttgccggtggggag

SEQ ID NO: 321 - DNA, 20 bp, Artificial
  20-mer unique DNA sequence
caattccacgcctcccgatg

SEQ ID NO: 322 - DNA, 20 bp, Artificial
  20-mer unique DNA sequence
ttttgtgttcggtggcgtcc

SEQ ID NO: 323 - DNA, 20 bp, Artificial
  20-mer unique DNA sequence
gttgacggcgtacctccaca

SEQ ID NO: 324 - DNA, 20 bp, Artificial
  20-mer unique DNA sequence
gtgagggcgggtgatttgct

SEQ ID NO: 325 - DNA, 20 bp, Artificial
  20-mer unique DNA sequence
cgagatttttgacccccgcc

SEQ ID NO: 326 - DNA, 20 bp, Artificial
  20-mer unique DNA sequence
gactgaccgcaccccttgca

SEQ ID NO: 327 - DNA, 20 bp, Artificial
  20-mer unique DNA sequence
acgttattacctccgcggcg

SEQ ID NO: 328 - DNA, 20 bp, Artificial
  20-mer unique DNA sequence
atgcggacgtacggaagggg

SEQ ID NO: 329 - DNA, 20 bp, Artificial
  20-mer unique DNA sequence
agccgggtatgcgattttgg

SEQ ID NO: 330 - DNA, 20 bp, Artificial
  20-mer unique DNA sequence
aagcgtttagcgatgcccga

SEQ ID NO: 331 - DNA, 20 bp, Artificial
  20-mer unique DNA sequence
ccgacatacacccccgcacc

SEQ ID NO: 332 - DNA, 20 bp, Artificial
  20-mer unique DNA sequence
ggggctgggagaggaacaca

SEQ ID NO: 333 - DNA, 20 bp, Artificial
  20-mer unique DNA sequence
accatcggcacccaaagacc

SEQ ID NO: 334 - DNA, 20 bp, Artificial
  20-mer unique DNA sequence
ccggagaggatttgcagccc

SEQ ID NO: 335 - DNA, 20 bp, Artificial
  20-mer unique DNA sequence
cgccagccgagggagaaata

SEQ ID NO: 336 - DNA, 20 bp, Artificial
  20-mer unique DNA sequence
ttatacgggggctgacggga

SEQ ID NO: 337 - DNA, 20 bp, Artificial
  20-mer unique DNA sequence
tgccacagagccgacaaagc

SEQ ID NO: 338 - DNA, 20 bp, Artificial
  20-mer unique DNA sequence
cgcgaccgaagggacacaaa

SEQ ID NO: 339 - DNA, 20 bp, Artificial
  20-mer unique DNA sequence
tgggtttggagggggggttc

SEQ ID NO: 340 - DNA, 20 bp, Artificial
  20-mer unique DNA sequence
tcttggagcggttcgggtcg

SEQ ID NO: 341 - DNA, 20 bp, Artificial
  20-mer unique DNA sequence
cggacacctccccaagaagg

SEQ ID NO: 342 - DNA, 20 bp, Artificial
  20-mer unique DNA sequence
ccggggccttatatgggcga

SEQ ID NO: 343 - DNA, 20 bp, Artificial
  20-mer unique DNA sequence
ttcttcgaccgccaattccg

SEQ ID NO: 344 - DNA, 20 bp, Artificial
  20-mer unique DNA sequence
tatcgacccacccccccttg

SEQ ID NO: 345 - DNA, 20 bp, Artificial
  20-mer unique DNA sequence
tccctactcccaagcgccgg

SEQ ID NO: 346 - DNA, 20 bp, Artificial
  20-mer unique DNA sequence
agaggggtctgctgtggcgt

SEQ ID NO: 347 - DNA, 20 bp, Artificial
  20-mer unique DNA sequence
atcagttttggggacgcgcg

SEQ ID NO: 348 - DNA, 20 bp, Artificial
  20-mer unique DNA sequence
aggtgcgctcggggtcttga

SEQ ID NO: 349 - DNA, 20 bp, Artificial
  20-mer unique DNA sequence
tgcaaagaccggcccactcg

SEQ ID NO: 350 - DNA, 20 bp, Artificial
  20-mer unique DNA sequence
catactaaggctcggcgcgg

SEQ ID NO: 351 - DNA, 20 bp, Artificial
  20-mer unique DNA sequence
ccgtcgtgctttgtgcccat

SEQ ID NO: 352 - DNA, 20 bp, Artificial
  20-mer unique DNA sequence
cccggggacttacctttgcc

SEQ ID NO: 353 - DNA, 20 bp, Artificial
  20-mer unique DNA sequence
caccccagcgagctaaccca

SEQ ID NO: 354 - DNA, 20 bp, Artificial
  20-mer unique DNA sequence
agagggtggttggcaggggc

SEQ ID NO: 355 - DNA, 20 bp, Artificial
  20-mer unique DNA sequence
cgcagtcggtaggagaggcc

SEQ ID NO: 356 - DNA, 20 bp, Artificial
  20-mer unique DNA sequence
ctgtaacgaactgggcggca

SEQ ID NO: 357 - DNA, 20 bp, Artificial
  20-mer unique DNA sequence
tgcgaacccgaaaaaacacg

SEQ ID NO: 358 - DNA, 20 bp, Artificial
  20-mer unique DNA sequence
tcatggagggaacggcacaa

SEQ ID NO: 359 - DNA, 20 bp, Artificial
  20-mer unique DNA sequence
tcaagccatgcccgaacaag

SEQ ID NO: 360 - DNA, 20 bp, Artificial
  20-mer unique DNA sequence
cttcctaccctgccacccga

SEQ ID NO: 361 - DNA, 20 bp, Artificial
  20-mer unique DNA sequence
caccctcaacgcatccccct

SEQ ID NO: 362 - DNA, 20 bp, Artificial
  20-mer unique DNA sequence
tcgggtggggttgtttttgc

SEQ ID NO: 363 - DNA, 20 bp, Artificial
  20-mer unique DNA sequence
gcgtttgcatgactccctcg

SEQ ID NO: 364 - DNA, 20 bp, Artificial
  20-mer unique DNA sequence
cgataaaccaacgcagcccc

SEQ ID NO: 365 - DNA, 20 bp, Artificial
  20-mer unique DNA sequence
tgccccgatacccatctccg

SEQ ID NO: 366 - DNA, 20 bp, Artificial
  20-mer unique DNA sequence
tgcccttcgtctgccttcgc

SEQ ID NO: 367 - DNA, 20 bp, Artificial
  20-mer unique DNA sequence
atcctccattcccgctgtcg

SEQ ID NO: 368 - DNA, 20 bp, Artificial
  20-mer unique DNA sequence
ggtcagggaacaggcagcgc

SEQ ID NO: 369 - DNA, 20 bp, Artificial
  20-mer unique DNA sequence
cgggcagttgtgggcttggt

SEQ ID NO: 370 - DNA, 20 bp, Artificial
  20-mer unique DNA sequence
aggaaggtggacagggccgg

SEQ ID NO: 371 - DNA, 20 bp, Artificial
  20-mer unique DNA sequence
acgacagcagacgggggatt

SEQ ID NO: 372 - DNA, 20 bp, Artificial
  20-mer unique DNA sequence
acatagaccgctcccccgcc

SEQ ID NO: 373 - DNA, 20 bp, Artificial
  20-mer unique DNA sequence
ttggtgccgtgctgggttac

SEQ ID NO: 374 - DNA, 20 bp, Artificial
  20-mer unique DNA sequence
cacaaaaggggtcagcggga

SEQ ID NO: 375 - DNA, 20 bp, Artificial
  20-mer unique DNA sequence
agaccccgcccttattgcag

SEQ ID NO: 376 - DNA, 20 bp, Artificial
  20-mer unique DNA sequence
aatgcccgctgaccgctgtc

SEQ ID NO: 377 - DNA, 20 bp, Artificial
  20-mer unique DNA sequence
aagggggtgttggggaggca

SEQ ID NO: 378 - DNA, 20 bp, Artificial
  20-mer unique DNA sequence
gggtggcaaagtggtcgggt

SEQ ID NO: 379 - DNA, 20 bp, Artificial
  20-mer unique DNA sequence
tggtaagaacaagaggccgc

SEQ ID NO: 380 - DNA, 20 bp, Artificial
  20-mer unique DNA sequence
tgcccccacccatcttcaac

SEQ ID NO: 381 - DNA, 20 bp, Artificial
  20-mer unique DNA sequence
aggttcaggtagcgcgtcgg

SEQ ID NO: 382 - DNA, 20 bp, Artificial
  20-mer unique DNA sequence
atgccgcgtggtttaggtcg

SEQ ID NO: 383 - DNA, 20 bp, Artificial
  20-mer unique DNA sequence
ggcgccctctatccaccgta

SEQ ID NO: 384 - DNA, 20 bp, Artificial
  20-mer unique DNA sequence
taagcggtcagagtgggcga

SEQ ID NO: 385 - DNA, 20 bp, Artificial
  20-mer unique DNA sequence
tgagcagggctaacgtcgga

SEQ ID NO: 386 - DNA, 20 bp, Artificial
  20-mer unique DNA sequence
cgaaacgggaacgagcacaa

SEQ ID NO: 387 - DNA, 20 bp, Artificial
  20-mer unique DNA sequence
tgaacacgccggggacaaac

SEQ ID NO: 388 - DNA, 20 bp, Artificial
  20-mer unique DNA sequence
tcatccaccaaacgcatccg

SEQ ID NO: 389 - DNA, 20 bp, Artificial
  20-mer unique DNA sequence
ttgtagcaggcgccgggatt

SEQ ID NO: 390 - DNA, 20 bp, Artificial
  20-mer unique DNA sequence
gtttcgcaggccgttgtccc

SEQ ID NO: 391 - DNA, 20 bp, Artificial
  20-mer unique DNA sequence
cgtgcttaattcgggagggg

SEQ ID NO: 392 - DNA, 20 bp, Artificial
  20-mer unique DNA sequence
tagaaggccggagcgaggga

SEQ ID NO: 393 - DNA, 20 bp, Artificial
  20-mer unique DNA sequence
accccccacgacagcctacg

SEQ ID NO: 394 - DNA, 20 bp, Artificial
  20-mer unique DNA sequence
gactccggccttccattgca

SEQ ID NO: 395 - DNA, 20 bp, Artificial
  20-mer unique DNA sequence
ggcttcgtcgggttggctac

SEQ ID NO: 396 - DNA, 20 bp, Artificial
  20-mer unique DNA sequence
ctcggtcgttgataggggcg

SEQ ID NO: 397 - DNA, 20 bp, Artificial
  20-mer unique DNA sequence
tgagaacgcgcgggaccact

SEQ ID NO: 398 - DNA, 20 bp, Artificial
  20-mer unique DNA sequence
ttatcaggctccacacggcg

SEQ ID NO: 399 - DNA, 20 bp, Artificial
  20-mer unique DNA sequence
ttgcggttgagcgtttgtgg

SEQ ID NO: 400 - DNA, 20 bp, Artificial
  20-mer unique DNA sequence
tcgggaggcaatgagcggtt

SEQ ID NO: 401 - DNA, 20 bp, Artificial
  20-mer unique DNA sequence
acccccattcccgaccacaa

SEQ ID NO: 402 - DNA, 20 bp, Artificial
  20-mer unique DNA sequence
ttggccgcgggtagtaaggt

SEQ ID NO: 403 - DNA, 20 bp, Artificial
  20-mer unique DNA sequence
cttaaggggtgattggccgc

SEQ ID NO: 404 - DNA, 20 bp, Artificial
  20-mer unique DNA sequence
aagcgcacgtagagtggtca

SEQ ID NO: 405 - DNA, 20 bp, Artificial
  20-mer unique DNA sequence
atgagcccgtgcgaatcagg

SEQ ID NO: 406 - DNA, 20 bp, Artificial
  20-mer unique DNA sequence
cgtggggcatgctagcttaa

SEQ ID NO: 407 - DNA, 20 bp, Artificial
  20-mer unique DNA sequence
ggccccctccccattcgatg

SEQ ID NO: 408 - DNA, 20 bp, Artificial
  20-mer unique DNA sequence
tccctgatccgcgtagcatg

SEQ ID NO: 409 - DNA, 20 bp, Artificial
  20-mer unique DNA sequence
cgggagtcttggcgcaattg

SEQ ID NO: 410 - DNA, 20 bp, Artificial
  20-mer unique DNA sequence
aagcagggaggaggccaagc

SEQ ID NO: 411 - DNA, 20 bp, Artificial
  20-mer unique DNA sequence
atgctattggtcgggctggg

SEQ ID NO: 412 - DNA, 20 bp, Artificial
  20-mer unique DNA sequence
ctggtcgtggttggggtgca

SEQ ID NO: 413 - DNA, 20 bp, Artificial
  20-mer unique DNA sequence
gcgcaggggaccgagatacg

SEQ ID NO: 414 - DNA, 20 bp, Artificial
  20-mer unique DNA sequence
atggacgaggtgcgagagac

SEQ ID NO: 415 - DNA, 20 bp, Artificial
  20-mer unique DNA sequence
tcgccccacccctcgttatc

SEQ ID NO: 416 - DNA, 20 bp, Artificial
  20-mer unique DNA sequence
acatgccgtcctccgcctcc

SEQ ID NO: 417 - DNA, 20 bp, Artificial
  20-mer unique DNA sequence
gcattaaccaggcgcgcagc

SEQ ID NO: 418 - DNA, 20 bp, Artificial
  20-mer unique DNA sequence
gggggaaaagtggggcttcg

SEQ ID NO: 419 - DNA, 20 bp, Artificial
  20-mer unique DNA sequence
cacaaggtccccccacggct

SEQ ID NO: 420 - DNA, 20 bp, Artificial
  20-mer unique DNA sequence
tccccccgtctcgtcatttc

SEQ ID NO: 421 - DNA, 20 bp, Artificial
  20-mer unique DNA sequence
cggcccaatcagcagcaaag

SEQ ID NO: 422 - DNA, 20 bp, Artificial
  20-mer unique DNA sequence
tgccgactcaggcggaaaac

SEQ ID NO: 423 - DNA, 20 bp, Artificial
  20-mer unique DNA sequence
ttaaccgggtcgcacactcg

SEQ ID NO: 424 - DNA, 20 bp, Artificial
  20-mer unique DNA sequence
tcgcgcggactcaaatggac

SEQ ID NO: 425 - DNA, 20 bp, Artificial
  20-mer unique DNA sequence
gccaacgccaatcccgaatc

SEQ ID NO: 426 - DNA, 20 bp, Artificial
  20-mer unique DNA sequence
agatgggggggctaaccgaa

SEQ ID NO: 427 - DNA, 20 bp, Artificial
  20-mer unique DNA sequence
taccgccctccttcaccgac

SEQ ID NO: 428 - DNA, 20 bp, Artificial
  20-mer unique DNA sequence
tcttgtggcgtttgcctcgg

SEQ ID NO: 429 - DNA, 20 bp, Artificial
  20-mer unique DNA sequence
cccaccatctcgttccctgg

SEQ ID NO: 430 - DNA, 20 bp, Artificial
  20-mer unique DNA sequence
tgcgagctagcctacgtcag

SEQ ID NO: 431 - DNA, 20 bp, Artificial
  20-mer unique DNA sequence
aacccgttgatctccggacc

SEQ ID NO: 432 - DNA, 20 bp, Artificial
  20-mer unique DNA sequence
tctgaggggatgcgtgacag

SEQ ID NO: 433 - DNA, 20 bp, Artificial
  20-mer unique DNA sequence
cgactttcagcccccgacat

SEQ ID NO: 434 - DNA, 20 bp, Artificial
  20-mer unique DNA sequence
ccgaagcgccaacccacagt

SEQ ID NO: 435 - DNA, 20 bp, Artificial
  20-mer unique DNA sequence
acattaggatccacggggcg

SEQ ID NO: 436 - DNA, 20 bp, Artificial
  20-mer unique DNA sequence
tttctttgcccgtgcgtcgt

SEQ ID NO: 437 - DNA, 20 bp, Artificial
  20-mer unique DNA sequence
atagtagcgcgcgcatgagt

SEQ ID NO: 438 - DNA, 20 bp, Artificial
  20-mer unique DNA sequence
cgtcaagcgaaaggccccac

SEQ ID NO: 439 - DNA, 20 bp, Artificial
  20-mer unique DNA sequence
ccgtgttaatgggcgccgac

SEQ ID NO: 440 - DNA, 20 bp, Artificial
  20-mer unique DNA sequence
cttggtgagcgcgatgtgtc

SEQ ID NO: 441 - DNA, 20 bp, Artificial
  20-mer unique DNA sequence
cagaccccgagtagcacgca

SEQ ID NO: 442 - DNA, 20 bp, Artificial
  20-mer unique DNA sequence
cacccgccttccgttgtcag

SEQ ID NO: 443 - DNA, 20 bp, Artificial
  20-mer unique DNA sequence
ttcgtcccctccgcttgttc

SEQ ID NO: 444 - DNA, 20 bp, Artificial
  20-mer unique DNA sequence
tgcgcccatgcctcgtagtc

SEQ ID NO: 445 - DNA, 20 bp, Artificial
  20-mer unique DNA sequence
cgcctactctttcgctgccc

SEQ ID NO: 446 - DNA, 20 bp, Artificial
  20-mer unique DNA sequence
gcgggttcgggattttaggg

SEQ ID NO: 447 - DNA, 20 bp, Artificial
  20-mer unique DNA sequence
tcgggttgctgtgaggggag

SEQ ID NO: 448 - DNA, 20 bp, Artificial
  20-mer unique DNA sequence
gacacgccctaacgcctccg

SEQ ID NO: 449 - DNA, 20 bp, Artificial
  20-mer unique DNA sequence
cggtcacggagaaagaggcg

SEQ ID NO: 450 - DNA, 20 bp, Artificial
  20-mer unique DNA sequence
ctgcacgcccatacgaaccg

SEQ ID NO: 451 - DNA, 20 bp, Artificial
  20-mer unique DNA sequence
ccgttgccttgctgtacccc

SEQ ID NO: 452 - DNA, 20 bp, Artificial
  20-mer unique DNA sequence
gcccccaacaggagcaggac

SEQ ID NO: 453 - DNA, 20 bp, Artificial
  20-mer unique DNA sequence
cttggcggtgctctgtgggg

SEQ ID NO: 454 - DNA, 20 bp, Artificial
  20-mer unique DNA sequence
gaccgcggttgtcccctttg

SEQ ID NO: 455 - DNA, 20 bp, Artificial
  20-mer unique DNA sequence
tctgggcaactggcggaagt

SEQ ID NO: 456 - DNA, 20 bp, Artificial
  20-mer unique DNA sequence
ccccgctttcatgcacgacc

SEQ ID NO: 457 - DNA, 20 bp, Artificial
  20-mer unique DNA sequence
tttcaacggcgaggacgaga

SEQ ID NO: 458 - DNA, 20 bp, Artificial
  20-mer unique DNA sequence
gttgtaggacggggctgggc

SEQ ID NO: 459 - DNA, 20 bp, Artificial
  20-mer unique DNA sequence
atacttggttgggcggggga

SEQ ID NO: 460 - DNA, 20 bp, Artificial
  20-mer unique DNA sequence
cgcccgaccttcatttacgc

SEQ ID NO: 461 - DNA, 20 bp, Artificial
  20-mer unique DNA sequence
ttcgcgccgcctgataacct

SEQ ID NO: 462 - DNA, 20 bp, Artificial
  20-mer unique DNA sequence
aaagtagttcctgcgcccgc

SEQ ID NO: 463 - DNA, 20 bp, Artificial
  20-mer unique DNA sequence
ccacccatgcatcgccactt

SEQ ID NO: 464 - DNA, 20 bp, Artificial
  20-mer unique DNA sequence
atcgggtgctgtcgctgtcg

SEQ ID NO: 465 - DNA, 20 bp, Artificial
  20-mer unique DNA sequence
tatggagggcgcacaggcaa

SEQ ID NO: 466 - DNA, 20 bp, Artificial
  20-mer unique DNA sequence
aaatgcggggtgtgggactc

SEQ ID NO: 467 - DNA, 20 bp, Artificial
  20-mer unique DNA sequence
gctacggtctggaggtcggg

SEQ ID NO: 468 - DNA, 20 bp, Artificial
  20-mer unique DNA sequence
aaacctacccctgtaccgcc

SEQ ID NO: 469 - DNA, 20 bp, Artificial
  20-mer unique DNA sequence
cttaagggagggcgcgagaa

SEQ ID NO: 470 - DNA, 20 bp, Artificial
  20-mer unique DNA sequence
ccccccacttccagcactcg

SEQ ID NO: 471 - DNA, 20 bp, Artificial
  20-mer unique DNA sequence
ttagtcgccagcccgtcctc

SEQ ID NO: 472 - DNA, 20 bp, Artificial
  20-mer unique DNA sequence
gcggccggggttagggagta

SEQ ID NO: 473 - DNA, 20 bp, Artificial
  20-mer unique DNA sequence
ggtgcgtccggttgctcttc

SEQ ID NO: 474 - DNA, 20 bp, Artificial
  20-mer unique DNA sequence
cgcaacaaacctgcacgcga

SEQ ID NO: 475 - DNA, 20 bp, Artificial
  20-mer unique DNA sequence
gtaccggccaagtcagcgct

SEQ ID NO: 476 - DNA, 20 bp, Artificial
  20-mer unique DNA sequence
gggggccgtgggatatgagg

SEQ ID NO: 477 - DNA, 20 bp, Artificial
  20-mer unique DNA sequence
atgcggccgtgttgatttgc

SEQ ID NO: 478 - DNA, 20 bp, Artificial
  20-mer unique DNA sequence
gttaccgcgggcttctgtgg

SEQ ID NO: 479 - DNA, 20 bp, Artificial
  20-mer unique DNA sequence
aatgatggcggtggaggacg

SEQ ID NO: 480 - DNA, 20 bp, Artificial
  20-mer unique DNA sequence
aggtcgacaggaggggaggc

SEQ ID NO: 481 - DNA, 20 bp, Artificial
  20-mer unique DNA sequence
aaacaatgtcgcacgtcggg

SEQ ID NO: 482 - DNA, 20 bp, Artificial
  20-mer unique DNA sequence
gcctcacgcacaacagaccg

SEQ ID NO: 483 - DNA, 20 bp, Artificial
  20-mer unique DNA sequence
cacgtggcgccctctccctt

SEQ ID NO: 484 - DNA, 20 bp, Artificial
  20-mer unique DNA sequence
atcgtaagggtttttgggct

SEQ ID NO: 485 - DNA, 20 bp, Artificial
  20-mer unique DNA sequence
cggtccagccatccacaagg

SEQ ID NO: 486 - DNA, 20 bp, Artificial
  20-mer unique DNA sequence
ggggcttagtgctggtggga

SEQ ID NO: 487 - DNA, 20 bp, Artificial
  20-mer unique DNA sequence
gggtctgggggcgattacaa

SEQ ID NO: 488 - DNA, 20 bp, Artificial
  20-mer unique DNA sequence
cgccgagaaaaacagccagc

SEQ ID NO: 489 - DNA, 20 bp, Artificial
  20-mer unique DNA sequence
tgtgggttgacgagctggcg

SEQ ID NO: 490 - DNA, 20 bp, Artificial
  20-mer unique DNA sequence
acgaatgtgagtgcctgggg

SEQ ID NO: 491 - DNA, 20 bp, Artificial
  20-mer unique DNA sequence
gcttggtgattgtggcggag

SEQ ID NO: 492 - DNA, 20 bp, Artificial
  20-mer unique DNA sequence
ctcacgccgcttatttcgcc

SEQ ID NO: 493 - DNA, 20 bp, Artificial
  20-mer unique DNA sequence
gggcggaggaccggtacaga

SEQ ID NO: 494 - DNA, 20 bp, Artificial
  20-mer unique DNA sequence
aacgtggcgggctggtgtaa

SEQ ID NO: 495 - DNA, 20 bp, Artificial
  20-mer unique DNA sequence
ccggattaacgaccacgcct

SEQ ID NO: 496 - DNA, 20 bp, Artificial
  20-mer unique DNA sequence
cgcacaggtccccagccaac

SEQ ID NO: 497 - DNA, 20 bp, Artificial
  20-mer unique DNA sequence
tctgccgcttcccaataccg

SEQ ID NO: 498 - DNA, 20 bp, Artificial
  20-mer unique DNA sequence
gcaacctggcctcgacaacg

SEQ ID NO: 499 - DNA, 20 bp, Artificial
  20-mer unique DNA sequence
acggtcctgcgaaactgccc

SEQ ID NO: 500 - DNA, 20 bp, Artificial
  20-mer unique DNA sequence
ttacgggagggacggcaatg

SEQ ID NO: 501 - DNA, 20 bp, Artificial
  20-mer unique DNA sequence
aaagtgggtcgtggggcgat

SEQ ID NO: 502 - DNA, 20 bp, Artificial
  20-mer unique DNA sequence
gaggggcaaccgaaagcgag

SEQ ID NO: 503 - DNA, 20 bp, Artificial
  20-mer unique DNA sequence
ggtcgagtggggggcctttg

SEQ ID NO: 504 - DNA, 20 bp, Artificial
  20-mer unique DNA sequence
gatcggggtttagacggggg

SEQ ID NO: 505 - DNA, 20 bp, Artificial
  20-mer unique DNA sequence
tgttgggcgaagaatgctgg

SEQ ID NO: 506 - DNA, 20 bp, Artificial
  20-mer unique DNA sequence
acatcgattaccgaccgccc

SEQ ID NO: 507 - DNA, 20 bp, Artificial
  20-mer unique DNA sequence
ggcggggtgagttggtgctt

SEQ ID NO: 508 - DNA, 20 bp, Artificial
  20-mer unique DNA sequence
tagggagggggggtgaacga

SEQ ID NO: 509 - DNA, 20 bp, Artificial
  20-mer unique DNA sequence
atatcagaaggaccggcgcg

SEQ ID NO: 510 - DNA, 20 bp, Artificial
  20-mer unique DNA sequence
aaacgccaccgcatacccag

SEQ ID NO: 511 - DNA, 20 bp, Artificial
  20-mer unique DNA sequence
ggtggctgggagagagcgga

SEQ ID NO: 512 - DNA, 20 bp, Artificial
  20-mer unique DNA sequence
gtgacaaatgctgggcgcct

SEQ ID NO: 513 - DNA, 20 bp, Artificial
  20-mer unique DNA sequence
tcgtagattgacccgcgcct

SEQ ID NO: 514 - DNA, 20 bp, Artificial
  20-mer unique DNA sequence
accgcccgaagtgtgctcac

SEQ ID NO: 515 - DNA, 20 bp, Artificial
  20-mer unique DNA sequence
accccatttcgccggttcct

SEQ ID NO: 516 - DNA, 20 bp, Artificial
  20-mer unique DNA sequence
agcgagggttgcgggtgaaa

SEQ ID NO: 517 - DNA, 20 bp, Artificial
  20-mer unique DNA sequence
tccccattcaaccggctctt

SEQ ID NO: 518 - DNA, 20 bp, Artificial
  20-mer unique DNA sequence
tcgccgcacagccctagacc

SEQ ID NO: 519 - DNA, 20 bp, Artificial
  20-mer unique DNA sequence
gggtcaaggggtgcagctgg

SEQ ID NO: 520 - DNA, 20 bp, Artificial
  20-mer unique DNA sequence
tcgggggaccttggttttag

SEQ ID NO: 521 - DNA, 20 bp, Artificial
  20-mer unique DNA sequence
taaccaggccggagcgacag

SEQ ID NO: 522 - DNA, 20 bp, Artificial
  20-mer unique DNA sequence
ccgctccaacacccccacag

SEQ ID NO: 523 - DNA, 20 bp, Artificial
  20-mer unique DNA sequence
ctacaacgctgcactcccgc

SEQ ID NO: 524 - DNA, 20 bp, Artificial
  20-mer unique DNA sequence
agcgagttagccgggtggcc

SEQ ID NO: 525 - DNA, 20 bp, Artificial
  20-mer unique DNA sequence
tacatcccgccaccacccac

SEQ ID NO: 526 - DNA, 20 bp, Artificial
  20-mer unique DNA sequence
tttttgcgcgccactgctct

SEQ ID NO: 527 - DNA, 20 bp, Artificial
  20-mer unique DNA sequence
tcgacaggccggaacaaagc

SEQ ID NO: 528 - DNA, 20 bp, Artificial
  20-mer unique DNA sequence
ccgtcgtcgccatagtctgg

SEQ ID NO: 529 - DNA, 20 bp, Artificial
  20-mer unique DNA sequence
gctggctaactgcggtgacg

SEQ ID NO: 530 - DNA, 20 bp, Artificial
  20-mer unique DNA sequence
cacacgaaatctggcgctcg

SEQ ID NO: 531 - DNA, 20 bp, Artificial
  20-mer unique DNA sequence
tcggactaggtgcattgccg

SEQ ID NO: 532 - DNA, 20 bp, Artificial
  20-mer unique DNA sequence
cgccctgacgagcaaccact

SEQ ID NO: 533 - DNA, 20 bp, Artificial
  20-mer unique DNA sequence
accggcgccccatactcaag

SEQ ID NO: 534 - DNA, 20 bp, Artificial
  20-mer unique DNA sequence
ggagttcccggtcagacgtt

SEQ ID NO: 535 - DNA, 20 bp, Artificial
  20-mer unique DNA sequence
cgggtcgttgcctggtctgg

SEQ ID NO: 536 - DNA, 20 bp, Artificial
  20-mer unique DNA sequence
tccgcagctggggatcatac

SEQ ID NO: 537 - DNA, 20 bp, Artificial
  20-mer unique DNA sequence
tcaaaacggacgccccaaca

SEQ ID NO: 538 - DNA, 20 bp, Artificial
  20-mer unique DNA sequence
aaggaagaggctggggcacg

SEQ ID NO: 539 - DNA, 20 bp, Artificial
  20-mer unique DNA sequence
acggtcggctagcaggttgg

SEQ ID NO: 540 - DNA, 20 bp, Artificial
  20-mer unique DNA sequence
ttccgcctcgatcccttcca

SEQ ID NO: 541 - DNA, 20 bp, Artificial
  20-mer unique DNA sequence
catcgctcgctacgcgatct

SEQ ID NO: 542 - DNA, 20 bp, Artificial
  20-mer unique DNA sequence
cgacactccaagctcccggg

SEQ ID NO: 543 - DNA, 20 bp, Artificial
  20-mer unique DNA sequence
gcccgtgccctcaattggat

SEQ ID NO: 544 - DNA, 20 bp, Artificial
  20-mer unique DNA sequence
tcgggctcagtgcgtacaac

SEQ ID NO: 545 - DNA, 20 bp, Artificial
  20-mer unique DNA sequence
tgcgcttaggtccgcaacat

SEQ ID NO: 546 - DNA, 20 bp, Artificial
  20-mer unique DNA sequence
agggcttgagattcgggcgg

SEQ ID NO: 547 - DNA, 20 bp, Artificial
  20-mer unique DNA sequence
aggtgcgctgtggggggaag

SEQ ID NO: 548 - DNA, 20 bp, Artificial
  20-mer unique DNA sequence
gcgggtgtggagtagcgagc

SEQ ID NO: 549 - DNA, 20 bp, Artificial
  20-mer unique DNA sequence
ccgcggcaccaagtaggaat

SEQ ID NO: 550 - DNA, 20 bp, Artificial
  20-mer unique DNA sequence
ccgacatagagccgcacctg

SEQ ID NO: 551 - DNA, 20 bp, Artificial
  20-mer unique DNA sequence
gaaactccgctccgcacccc

SEQ ID NO: 552 - DNA, 20 bp, Artificial
  20-mer unique DNA sequence
ggaaagctaaagggcacgcg

SEQ ID NO: 553 - DNA, 20 bp, Artificial
  20-mer unique DNA sequence
ctgcgcggtgtcttttgcct

SEQ ID NO: 554 - DNA, 20 bp, Artificial
  20-mer unique DNA sequence
tcctctgcggtggtcgtgtc

SEQ ID NO: 555 - DNA, 20 bp, Artificial
  20-mer unique DNA sequence
ctcaggggtagtgcaggcga

SEQ ID NO: 556 - DNA, 20 bp, Artificial
  20-mer unique DNA sequence
ggcgattccaagggcgagtt

SEQ ID NO: 557 - DNA, 20 bp, Artificial
  20-mer unique DNA sequence
ctctgcgcattaagcgccat

SEQ ID NO: 558 - DNA, 20 bp, Artificial
  20-mer unique DNA sequence
ttccgcccaccacctatcga

SEQ ID NO: 559 - DNA, 20 bp, Artificial
  20-mer unique DNA sequence
gagggcgcgcttgtcacttt

SEQ ID NO: 560 - DNA, 20 bp, Artificial
  20-mer unique DNA sequence
accaccattcggacccatcc

SEQ ID NO: 561 - DNA, 20 bp, Artificial
  20-mer unique DNA sequence
tcaggcatggcgtgggtttg

SEQ ID NO: 562 - DNA, 20 bp, Artificial
  20-mer unique DNA sequence
aagtggggcaggcgatcatc

SEQ ID NO: 563 - DNA, 20 bp, Artificial
  20-mer unique DNA sequence
cgtcaggcgagcaccggtta

SEQ ID NO: 564 - DNA, 20 bp, Artificial
  20-mer unique DNA sequence
gctcccgctgatggttgctt

SEQ ID NO: 565 - DNA, 20 bp, Artificial
  20-mer unique DNA sequence
cagacgaacaccgccgaccg

SEQ ID NO: 566 - DNA, 20 bp, Artificial
  20-mer unique DNA sequence
gggcccggtcatcttctcct

SEQ ID NO: 567 - DNA, 20 bp, Artificial
  20-mer unique DNA sequence
aggccgtgcgtggtaaggat

SEQ ID NO: 568 - DNA, 20 bp, Artificial
  20-mer unique DNA sequence
acggccgtcacagctgcttt

SEQ ID NO: 569 - DNA, 20 bp, Artificial
  20-mer unique DNA sequence
catccgggtgggtagacgcg

SEQ ID NO: 570 - DNA, 20 bp, Artificial
  20-mer unique DNA sequence
ctgcccaaccctcatcgcgt

SEQ ID NO: 571 - DNA, 20 bp, Artificial
  20-mer unique DNA sequence
ggataggctcgcaaaacggg

SEQ ID NO: 572 - DNA, 20 bp, Artificial
  20-mer unique DNA sequence
ctgatcgctcgcccaaatga

SEQ ID NO: 573 - DNA, 20 bp, Artificial
  20-mer unique DNA sequence
ccggcaggggaatgatgaag

SEQ ID NO: 574 - DNA, 20 bp, Artificial
  20-mer unique DNA sequence
tcattaccgtcgtgcccccg

SEQ ID NO: 575 - DNA, 20 bp, Artificial
  20-mer unique DNA sequence
gtcatggtgtgcggggctgt

SEQ ID NO: 576 - DNA, 20 bp, Artificial
  20-mer unique DNA sequence
accgtgcgaacggaacagtc

SEQ ID NO: 577 - DNA, 20 bp, Artificial
  20-mer unique DNA sequence
aaaatcaaggcacggggacg

SEQ ID NO: 578 - DNA, 20 bp, Artificial
  20-mer unique DNA sequence
cgcttcacaacccccagtcc

SEQ ID NO: 579 - DNA, 20 bp, Artificial
  20-mer unique DNA sequence
gttgtttgcatgcctccgga

SEQ ID NO: 580 - DNA, 20 bp, Artificial
  20-mer unique DNA sequence
ctgcctcgttcgtcgccttg

SEQ ID NO: 581 - DNA, 20 bp, Artificial
  20-mer unique DNA sequence
ttgttactcgtccggccctg

SEQ ID NO: 582 - DNA, 20 bp, Artificial
  20-mer unique DNA sequence
cgcacaagtatccccccgat

SEQ ID NO: 583 - DNA, 20 bp, Artificial
  20-mer unique DNA sequence
ccttgctccatcgcccttcg

SEQ ID NO: 584 - DNA, 20 bp, Artificial
  20-mer unique DNA sequence
cgcggccgtggtcatgttta

SEQ ID NO: 585 - DNA, 20 bp, Artificial
  20-mer unique DNA sequence
gcgatgggttggtggccttg

SEQ ID NO: 586 - DNA, 20 bp, Artificial
  20-mer unique DNA sequence
agagtggggggaaagtggcg

SEQ ID NO: 587 - DNA, 20 bp, Artificial
  20-mer unique DNA sequence
tcgaatagggaagcagcgca

SEQ ID NO: 588 - DNA, 20 bp, Artificial
  20-mer unique DNA sequence
tgcggcgtggcttgcttaca

SEQ ID NO: 589 - DNA, 20 bp, Artificial
  20-mer unique DNA sequence
acgaaaccggtatggggcag

SEQ ID NO: 590 - DNA, 20 bp, Artificial
  20-mer unique DNA sequence
ggctcccgcactcataaccg

SEQ ID NO: 591 - DNA, 20 bp, Artificial
  20-mer unique DNA sequence
accccccccagtttagtcgg

SEQ ID NO: 592 - DNA, 20 bp, Artificial
  20-mer unique DNA sequence
gcgcaccgttcccatgtttg

SEQ ID NO: 593 - DNA, 20 bp, Artificial
  20-mer unique DNA sequence
gccccgcaaaaaaaagcaca

SEQ ID NO: 594 - DNA, 20 bp, Artificial
  20-mer unique DNA sequence
acggcacgcggagagagaga

SEQ ID NO: 595 - DNA, 20 bp, Artificial
  20-mer unique DNA sequence
ggactaatgcaccccgcctc

SEQ ID NO: 596 - DNA, 20 bp, Artificial
  20-mer unique DNA sequence
ccggacgccttcgcacctta

SEQ ID NO: 597 - DNA, 20 bp, Artificial
  20-mer unique DNA sequence
cttggcggtgttctcggacg

SEQ ID NO: 598 - DNA, 20 bp, Artificial
  20-mer unique DNA sequence
ccccacaccgacttgcacca

SEQ ID NO: 599 - DNA, 20 bp, Artificial
  20-mer unique DNA sequence
cccccctgcggaagtacgtc

SEQ ID NO: 600 - DNA, 20 bp, Artificial
  20-mer unique DNA sequence
cagtggggctttaggcgtcg

SEQ ID NO: 601 - DNA, 20 bp, Artificial
  20-mer unique DNA sequence
tgctttctctccggggcgtc

SEQ ID NO: 602 - DNA, 20 bp, Artificial
  20-mer unique DNA sequence
tggcgggttggtgcattttg

SEQ ID NO: 603 - DNA, 20 bp, Artificial
  20-mer unique DNA sequence
agcggaggcgacacataggg

SEQ ID NO: 604 - DNA, 20 bp, Artificial
  20-mer unique DNA sequence
gccttaccccttccagcccg

SEQ ID NO: 605 - DNA, 20 bp, Artificial
  20-mer unique DNA sequence
gctggatcggaggggacttg

SEQ ID NO: 606 - DNA, 20 bp, Artificial
  20-mer unique DNA sequence
aggtcggactggtcctgact

SEQ ID NO: 607 - DNA, 20 bp, Artificial
  20-mer unique DNA sequence
tgctgcacccttaacgaggt

SEQ ID NO: 608 - DNA, 20 bp, Artificial
  20-mer unique DNA sequence
aactttgaaccacccgcgca

SEQ ID NO: 609 - DNA, 20 bp, Artificial
  20-mer unique DNA sequence
ggttagggggggattcgagg

SEQ ID NO: 610 - DNA, 20 bp, Artificial
  20-mer unique DNA sequence
gtgtcttcgatttgcgcggg

SEQ ID NO: 611 - DNA, 20 bp, Artificial
  20-mer unique DNA sequence
aacagtagcagcgcagccca

SEQ ID NO: 612 - DNA, 20 bp, Artificial
  20-mer unique DNA sequence
accgccaagctgcacgaaac

SEQ ID NO: 613 - DNA, 20 bp, Artificial
  20-mer unique DNA sequence
ctgcgcatttccgtccttca

SEQ ID NO: 614 - DNA, 20 bp, Artificial
  20-mer unique DNA sequence
cactcgaccacaccgctccc

SEQ ID NO: 615 - DNA, 20 bp, Artificial
  20-mer unique DNA sequence
ggggctggaacgtgatggaa

SEQ ID NO: 616 - DNA, 20 bp, Artificial
  20-mer unique DNA sequence
gtgtttcgaggggggtgcag

SEQ ID NO: 617 - DNA, 20 bp, Artificial
  20-mer unique DNA sequence
ttcgttctcagcttcccgcc

SEQ ID NO: 618 - DNA, 20 bp, Artificial
  20-mer unique DNA sequence
ccgtggtgttcggcctctcg

SEQ ID NO: 619 - DNA, 20 bp, Artificial
  20-mer unique DNA sequence
aacttgcccccaccaactcg

SEQ ID NO: 620 - DNA, 20 bp, Artificial
  20-mer unique DNA sequence
cggggcggacatttgagtgg

SEQ ID NO: 621 - DNA, 20 bp, Artificial
  20-mer unique DNA sequence
gattaaaccgcctccgcccg

SEQ ID NO: 622 - DNA, 20 bp, Artificial
  20-mer unique DNA sequence
gccgcttccgattaccccac

SEQ ID NO: 623 - DNA, 20 bp, Artificial
  20-mer unique DNA sequence
acaaatcaccccagcgccca

SEQ ID NO: 624 - DNA, 20 bp, Artificial
  20-mer unique DNA sequence
agggccagcacgtaccgcaa

SEQ ID NO: 625 - DNA, 20 bp, Artificial
  20-mer unique DNA sequence
caaacgtggggcaaaaccgg

SEQ ID NO: 626 - DNA, 20 bp, Artificial
  20-mer unique DNA sequence
ataccacatcgcacggccgg

SEQ ID NO: 627 - DNA, 20 bp, Artificial
  20-mer unique DNA sequence
catcccgccacaaatcgctc

SEQ ID NO: 628 - DNA, 20 bp, Artificial
  20-mer unique DNA sequence
ctcccgaccttaagccgcct

SEQ ID NO: 629 - DNA, 20 bp, Artificial
  20-mer unique DNA sequence
ggaggacagcgggatggggt

SEQ ID NO: 630 - DNA, 20 bp, Artificial
  20-mer unique DNA sequence
ccggtgcgcgatgctagaat

SEQ ID NO: 631 - DNA, 20 bp, Artificial
  20-mer unique DNA sequence
ttgcttacggtcgggcttgc

SEQ ID NO: 632 - DNA, 20 bp, Artificial
  20-mer unique DNA sequence
ggacgctgacacgtcgttgt

SEQ ID NO: 633 - DNA, 20 bp, Artificial
  20-mer unique DNA sequence
tgtaacgtaccgtcgcgagc

SEQ ID NO: 634 - DNA, 20 bp, Artificial
  20-mer unique DNA sequence
aggtcggtgggggcagtgtg

SEQ ID NO: 635 - DNA, 20 bp, Artificial
  20-mer unique DNA sequence
gcagggtagggcggggattc

SEQ ID NO: 636 - DNA, 20 bp, Artificial
  20-mer unique DNA sequence
tgttgggttgcgtgtggtga

SEQ ID NO: 637 - DNA, 20 bp, Artificial
  20-mer unique DNA sequence
caccaccccattcgccgttc

SEQ ID NO: 638 - DNA, 20 bp, Artificial
  20-mer unique DNA sequence
aagccccagacaccgccgac

SEQ ID NO: 639 - DNA, 20 bp, Artificial
  20-mer unique DNA sequence
ccgttggattgtttggacga

SEQ ID NO: 640 - DNA, 20 bp, Artificial
  20-mer unique DNA sequence
gcaagaagcgcggggtacat

SEQ ID NO: 641 - DNA, 20 bp, Artificial
  20-mer unique DNA sequence
tgaggatgaggcacggagca

SEQ ID NO: 642 - DNA, 20 bp, Artificial
  20-mer unique DNA sequence
ccgccgtaaccacgaatggc

SEQ ID NO: 643 - DNA, 20 bp, Artificial
  20-mer unique DNA sequence
gacggcttacggggtcctgg

SEQ ID NO: 644 - DNA, 20 bp, Artificial
  20-mer unique DNA sequence
tttcctcctatacgcgcgcc

SEQ ID NO: 645 - DNA, 20 bp, Artificial
  20-mer unique DNA sequence
cacctagaccctgcctcccg

SEQ ID NO: 646 - DNA, 20 bp, Artificial
  20-mer unique DNA sequence
acgagcaaaatgggcggacg

SEQ ID NO: 647 - DNA, 20 bp, Artificial
  20-mer unique DNA sequence
gcccgcgccgtagttgtgac

SEQ ID NO: 648 - DNA, 20 bp, Artificial
  20-mer unique DNA sequence
aatggcctcgggctgggaag

SEQ ID NO: 649 - DNA, 20 bp, Artificial
  20-mer unique DNA sequence
taggggcggggatcagcgtc

SEQ ID NO: 650 - DNA, 20 bp, Artificial
  20-mer unique DNA sequence
cgcgaactctcagaggcact

SEQ ID NO: 651 - DNA, 20 bp, Artificial
  20-mer unique DNA sequence
tcgactggtcagggactgga

SEQ ID NO: 652 - DNA, 20 bp, Artificial
  20-mer unique DNA sequence
agcggaaagagaagaaccgg

SEQ ID NO: 653 - DNA, 20 bp, Artificial
  20-mer unique DNA sequence
cgctctgcctctggtctccg

SEQ ID NO: 654 - DNA, 20 bp, Artificial
  20-mer unique DNA sequence
tctgggtatgctctccgggg

SEQ ID NO: 655 - DNA, 20 bp, Artificial
  20-mer unique DNA sequence
tcagggggacgttgtggctc

SEQ ID NO: 656 - DNA, 20 bp, Artificial
  20-mer unique DNA sequence
acaccgcaccatctcaccgc

SEQ ID NO: 657 - DNA, 20 bp, Artificial
  20-mer unique DNA sequence
aattccttttcgcggctggc

SEQ ID NO: 658 - DNA, 20 bp, Artificial
  20-mer unique DNA sequence
tcgctgggcccttgttctgt

SEQ ID NO: 659 - DNA, 20 bp, Artificial
  20-mer unique DNA sequence
ggcaaaggatgcagggccta

SEQ ID NO: 660 - DNA, 20 bp, Artificial
  20-mer unique DNA sequence
tgggccgtgggttggaataa

SEQ ID NO: 661 - DNA, 20 bp, Artificial
  20-mer unique DNA sequence
aatggcaatcgcacggtggt

SEQ ID NO: 662 - DNA, 20 bp, Artificial
  20-mer unique DNA sequence
ggaaggcatggctggaagga

SEQ ID NO: 663 - DNA, 20 bp, Artificial
  20-mer unique DNA sequence
ggtcgtcgtctcgggctctt

SEQ ID NO: 664 - DNA, 20 bp, Artificial
  20-mer unique DNA sequence
ccgaaccccttatgccaccc

SEQ ID NO: 665 - DNA, 20 bp, Artificial
  20-mer unique DNA sequence
tacaactgcctcccccaccc

SEQ ID NO: 666 - DNA, 20 bp, Artificial
  20-mer unique DNA sequence
ctgaccgcggcctaactgct

SEQ ID NO: 667 - DNA, 20 bp, Artificial
  20-mer unique DNA sequence
cagattggcagtgggagcga

SEQ ID NO: 668 - DNA, 20 bp, Artificial
  20-mer unique DNA sequence
cttctccttttccgcgccca

SEQ ID NO: 669 - DNA, 20 bp, Artificial
  20-mer unique DNA sequence
gcatcatcgaaagcaggggg

SEQ ID NO: 670 - DNA, 20 bp, Artificial
  20-mer unique DNA sequence
aattgtttagcgccggccga

SEQ ID NO: 671 - DNA, 20 bp, Artificial
  20-mer unique DNA sequence
ccgaaccccactgcacgtga

SEQ ID NO: 672 - DNA, 20 bp, Artificial
  20-mer unique DNA sequence
cgcaacggactggggatcat

SEQ ID NO: 673 - DNA, 20 bp, Artificial
  20-mer unique DNA sequence
tccccccccctgtgcttaac

SEQ ID NO: 674 - DNA, 20 bp, Artificial
  20-mer unique DNA sequence
gactccggcttcgcttgcgg

SEQ ID NO: 675 - DNA, 20 bp, Artificial
  20-mer unique DNA sequence
cccaagccctgattcccctg

SEQ ID NO: 676 - DNA, 20 bp, Artificial
  20-mer unique DNA sequence
tgtttccctggcgcttcgtc

SEQ ID NO: 677 - DNA, 20 bp, Artificial
  20-mer unique DNA sequence
gaaggcgatggggagaccga

SEQ ID NO: 678 - DNA, 20 bp, Artificial
  20-mer unique DNA sequence
cgtctcactccgcccttgcg

SEQ ID NO: 679 - DNA, 20 bp, Artificial
  20-mer unique DNA sequence
tcccatcaccacgtccagcg

SEQ ID NO: 680 - DNA, 20 bp, Artificial
  20-mer unique DNA sequence
ttttgattcccggacgctgg

SEQ ID NO: 681 - DNA, 20 bp, Artificial
  20-mer unique DNA sequence
cctggccctgcttcgtaacg

SEQ ID NO: 682 - DNA, 20 bp, Artificial
  20-mer unique DNA sequence
gccgcttcgctgttactcgt

SEQ ID NO: 683 - DNA, 20 bp, Artificial
  20-mer unique DNA sequence
cgggtgggcgcaatgaagag

SEQ ID NO: 684 - DNA, 20 bp, Artificial
  20-mer unique DNA sequence
gcggaagatagcggggatgc

SEQ ID NO: 685 - DNA, 20 bp, Artificial
  20-mer unique DNA sequence
tctggttgcgtggcgtgatt

SEQ ID NO: 686 - DNA, 20 bp, Artificial
  20-mer unique DNA sequence
ggttttcgacgcctgccttg

SEQ ID NO: 687 - DNA, 20 bp, Artificial
  20-mer unique DNA sequence
tcggcagagcattaaggggt

SEQ ID NO: 688 - DNA, 20 bp, Artificial
  20-mer unique DNA sequence
ctccgcacgcaacaccaacg

SEQ ID NO: 689 - DNA, 20 bp, Artificial
  20-mer unique DNA sequence
acaggcaaccaaccaagcgc

SEQ ID NO: 690 - DNA, 20 bp, Artificial
  20-mer unique DNA sequence
ttacgtaggaggtcggcgcg

SEQ ID NO: 691 - DNA, 20 bp, Artificial
  20-mer unique DNA sequence
cgaactgcgcacccaccact

SEQ ID NO: 692 - DNA, 20 bp, Artificial
  20-mer unique DNA sequence
tgcagtgggtcctttcgtgg

SEQ ID NO: 693 - DNA, 20 bp, Artificial
  20-mer unique DNA sequence
gcacgcgcaataacgacccc

SEQ ID NO: 694 - DNA, 20 bp, Artificial
  20-mer unique DNA sequence
caaaaagcaaccagtcggcg

SEQ ID NO: 695 - DNA, 20 bp, Artificial
  20-mer unique DNA sequence
cgaattccccgcgcataact

SEQ ID NO: 696 - DNA, 20 bp, Artificial
  20-mer unique DNA sequence
aggatggggggattttcgag

SEQ ID NO: 697 - DNA, 20 bp, Artificial
  20-mer unique DNA sequence
acccgcggcctgctacaaat

SEQ ID NO: 698 - DNA, 20 bp, Artificial
  20-mer unique DNA sequence
acccatgacggactccccta

SEQ ID NO: 699 - DNA, 20 bp, Artificial
  20-mer unique DNA sequence
atgggtcccgtcacgcttca

SEQ ID NO: 700 - DNA, 20 bp, Artificial
  20-mer unique DNA sequence
aaacattacggcggggagca

SEQ ID NO: 701 - DNA, 20 bp, Artificial
  20-mer unique DNA sequence
catcgttactaggcgccggg

SEQ ID NO: 702 - DNA, 20 bp, Artificial
  20-mer unique DNA sequence
cgcctgccgctctccgacta

SEQ ID NO: 703 - DNA, 20 bp, Artificial
  20-mer unique DNA sequence
cgccctcctaccccacgcta

SEQ ID NO: 704 - DNA, 20 bp, Artificial
  20-mer unique DNA sequence
tcagccgcccaacctagtcc

SEQ ID NO: 705 - DNA, 20 bp, Artificial
  20-mer unique DNA sequence
gggaatcaggcgcgaggaca

SEQ ID NO: 706 - DNA, 20 bp, Artificial
  20-mer unique DNA sequence
ttggggttctccttggcctg

SEQ ID NO: 707 - DNA, 20 bp, Artificial
  20-mer unique DNA sequence
tggcgcgggggatctgtagt

SEQ ID NO: 708 - DNA, 20 bp, Artificial
  20-mer unique DNA sequence
cgctccctcacacatccacg

SEQ ID NO: 709 - DNA, 20 bp, Artificial
  20-mer unique DNA sequence
tggccgtgtgtctttcctcg

SEQ ID NO: 710 - DNA, 20 bp, Artificial
  20-mer unique DNA sequence
ctgcgcgcaacagaggtcgt

SEQ ID NO: 711 - DNA, 20 bp, Artificial
  20-mer unique DNA sequence
cgccacgccgaggtaaccac

SEQ ID NO: 712 - DNA, 20 bp, Artificial
  20-mer unique DNA sequence
agccctctgacctgcacctt

SEQ ID NO: 713 - DNA, 20 bp, Artificial
  20-mer unique DNA sequence
attgtacgtgtgctgcggcg

SEQ ID NO: 714 - DNA, 20 bp, Artificial
  20-mer unique DNA sequence
cgcacgccctaccaaacgct

SEQ ID NO: 715 - DNA, 20 bp, Artificial
  20-mer unique DNA sequence
gaacagacgggtgggcgagg

SEQ ID NO: 716 - DNA, 20 bp, Artificial
  20-mer unique DNA sequence
tgtttcgggatctgctcgca

SEQ ID NO: 717 - DNA, 20 bp, Artificial
  20-mer unique DNA sequence
cgccgcgcaattatgttacg

SEQ ID NO: 718 - DNA, 20 bp, Artificial
  20-mer unique DNA sequence
aaacgctggcaggccaggaa

SEQ ID NO: 719 - DNA, 20 bp, Artificial
  20-mer unique DNA sequence
tacgttgcgagctgccacta

SEQ ID NO: 720 - DNA, 20 bp, Artificial
  20-mer unique DNA sequence
acaaaagacggcggagggga

SEQ ID NO: 721 - DNA, 20 bp, Artificial
  20-mer unique DNA sequence
agccccccaccgaaccattg

SEQ ID NO: 722 - DNA, 20 bp, Artificial
  20-mer unique DNA sequence
actgtgatttcggggggggt

SEQ ID NO: 723 - DNA, 20 bp, Artificial
  20-mer unique DNA sequence
tgttatccgagggtgccgcc

SEQ ID NO: 724 - DNA, 20 bp, Artificial
  20-mer unique DNA sequence
atgggggctgcttaccgtgt

SEQ ID NO: 725 - DNA, 20 bp, Artificial
  20-mer unique DNA sequence
cctgtttctcgcgtggtggg

SEQ ID NO: 726 - DNA, 20 bp, Artificial
  20-mer unique DNA sequence
ccccggtaaggatgggccaa

SEQ ID NO: 727 - DNA, 20 bp, Artificial
  20-mer unique DNA sequence
gcggtcgaaatggtcagggc

SEQ ID NO: 728 - DNA, 20 bp, Artificial
  20-mer unique DNA sequence
acggggtcactgggggctgt

SEQ ID NO: 729 - DNA, 20 bp, Artificial
  20-mer unique DNA sequence
acagcaagggtgggtcagcg

SEQ ID NO: 730 - DNA, 20 bp, Artificial
  20-mer unique DNA sequence
tcgcagccggggaacactag

SEQ ID NO: 731 - DNA, 20 bp, Artificial
  20-mer unique DNA sequence
cccgcccgtaaagttgcagc

SEQ ID NO: 732 - DNA, 20 bp, Artificial
  20-mer unique DNA sequence
gcccaacgcagagcccatca

SEQ ID NO: 733 - DNA, 20 bp, Artificial
  20-mer unique DNA sequence
cacccatacgcaacggccaa

SEQ ID NO: 734 - DNA, 20 bp, Artificial
  20-mer unique DNA sequence
gtgttttcatcccccgccat

SEQ ID NO: 735 - DNA, 20 bp, Artificial
  20-mer unique DNA sequence
aaatggcgatgaggcgacga

SEQ ID NO: 736 - DNA, 20 bp, Artificial
  20-mer unique DNA sequence
aaattatcgggcgggggtcc

SEQ ID NO: 737 - DNA, 20 bp, Artificial
  20-mer unique DNA sequence
gcgggggacaaaatcagctc

SEQ ID NO: 738 - DNA, 20 bp, Artificial
  20-mer unique DNA sequence
tgcacgcctctcatttcccg

SEQ ID NO: 739 - DNA, 20 bp, Artificial
  20-mer unique DNA sequence
ggaatggtggcaggaagggg

SEQ ID NO: 740 - DNA, 20 bp, Artificial
  20-mer unique DNA sequence
gagttgttcccgtgcgcttg

SEQ ID NO: 741 - DNA, 20 bp, Artificial
  20-mer unique DNA sequence
cgaatgggggtgctgttggg

SEQ ID NO: 742 - DNA, 20 bp, Artificial
  20-mer unique DNA sequence
cacttttccggcgacttggc

SEQ ID NO: 743 - DNA, 20 bp, Artificial
  20-mer unique DNA sequence
gcaccgcagaacccaaccag

SEQ ID NO: 744 - DNA, 20 bp, Artificial
  20-mer unique DNA sequence
aaaatccgccccccatcaaa

SEQ ID NO: 745 - DNA, 20 bp, Artificial
  20-mer unique DNA sequence
gcacactgacgaaccgccga

SEQ ID NO: 746 - DNA, 20 bp, Artificial
  20-mer unique DNA sequence
tcataagcccggaagcgcca

SEQ ID NO: 747 - DNA, 20 bp, Artificial
  20-mer unique DNA sequence
cctccagccgcacttttcga

SEQ ID NO: 748 - DNA, 20 bp, Artificial
  20-mer unique DNA sequence
ccaacccgccatcagcaaaa

SEQ ID NO: 749 - DNA, 20 bp, Artificial
  20-mer unique DNA sequence
cgtccctcctgacaccccat

SEQ ID NO: 750 - DNA, 20 bp, Artificial
  20-mer unique DNA sequence
cggtgaaggggaatgcgaac

SEQ ID NO: 751 - DNA, 20 bp, Artificial
  20-mer unique DNA sequence
tgtggccgcatggtcgatat

SEQ ID NO: 752 - DNA, 20 bp, Artificial
  20-mer unique DNA sequence
cgacctgcctacccgctccc

SEQ ID NO: 753 - DNA, 20 bp, Artificial
  20-mer unique DNA sequence
gctttggcctcggttgctgt

SEQ ID NO: 754 - DNA, 20 bp, Artificial
  20-mer unique DNA sequence
cgttacccgcatccagcaaa

SEQ ID NO: 755 - DNA, 20 bp, Artificial
  20-mer unique DNA sequence
gcgccaattagaccgacccc

SEQ ID NO: 756 - DNA, 20 bp, Artificial
  20-mer unique DNA sequence
gacggtgtggggcgaaggtg

SEQ ID NO: 757 - DNA, 20 bp, Artificial
  20-mer unique DNA sequence
acagcttcgcacagggcagt

SEQ ID NO: 758 - DNA, 20 bp, Artificial
  20-mer unique DNA sequence
gtcggttaagcggcggtgtg

SEQ ID NO: 759 - DNA, 20 bp, Artificial
  20-mer unique DNA sequence
cgacacgcctcacgaacgac

SEQ ID NO: 760 - DNA, 20 bp, Artificial
  20-mer unique DNA sequence
gcgcggcccctcaaccttat

SEQ ID NO: 761 - DNA, 20 bp, Artificial
  20-mer unique DNA sequence
accgggtcacgtaggctcaa

SEQ ID NO: 762 - DNA, 20 bp, Artificial
  20-mer unique DNA sequence
ggagacccagcgtggatgaa

SEQ ID NO: 763 - DNA, 20 bp, Artificial
  20-mer unique DNA sequence
ttcgaccggcacccttgttt

SEQ ID NO: 764 - DNA, 20 bp, Artificial
  20-mer unique DNA sequence
gccagccaacccatcaccct

SEQ ID NO: 765 - DNA, 20 bp, Artificial
  20-mer unique DNA sequence
agggtggcgcataacggagt

SEQ ID NO: 766 - DNA, 20 bp, Artificial
  20-mer unique DNA sequence
tagccgcgcccattgagaac

SEQ ID NO: 767 - DNA, 20 bp, Artificial
  20-mer unique DNA sequence
atcccaccccgctacttgca

SEQ ID NO: 768 - DNA, 20 bp, Artificial
  20-mer unique DNA sequence
ggcgcagctcaaaccaccga

SEQ ID NO: 769 - DNA, 20 bp, Artificial
  20-mer unique DNA sequence
tcgacaggggccagaagacg

SEQ ID NO: 770 - DNA, 20 bp, Artificial
  20-mer unique DNA sequence
agcgttagtgcgttggcgaa

SEQ ID NO: 771 - DNA, 20 bp, Artificial
  20-mer unique DNA sequence
tggcgcgaaagggatggttg

SEQ ID NO: 772 - DNA, 20 bp, Artificial
  20-mer unique DNA sequence
gtgcttgggggatgcgctta

SEQ ID NO: 773 - DNA, 20 bp, Artificial
  20-mer unique DNA sequence
ctcccgtgcgccttgacctc

SEQ ID NO: 774 - DNA, 20 bp, Artificial
  20-mer unique DNA sequence
tcacgtgtttggggcagagg

SEQ ID NO: 775 - DNA, 20 bp, Artificial
  20-mer unique DNA sequence
cccgcgcctccttcgtaatc

SEQ ID NO: 776 - DNA, 20 bp, Artificial
  20-mer unique DNA sequence
gaaacaaggtgcgcggatga

SEQ ID NO: 777 - DNA, 20 bp, Artificial
  20-mer unique DNA sequence
ttccccgcaaaaacacccaa

SEQ ID NO: 778 - DNA, 20 bp, Artificial
  20-mer unique DNA sequence
cgctttggtcgccctctcag

SEQ ID NO: 779 - DNA, 20 bp, Artificial
  20-mer unique DNA sequence
attctatcgatcgcgccggg

SEQ ID NO: 780 - DNA, 20 bp, Artificial
  20-mer unique DNA sequence
gatgggtggcgggtgattct

SEQ ID NO: 781 - DNA, 20 bp, Artificial
  20-mer unique DNA sequence
gggtatgggggtgtctcggg

SEQ ID NO: 782 - DNA, 20 bp, Artificial
  20-mer unique DNA sequence
gcggggagggggagacagac

SEQ ID NO: 783 - DNA, 20 bp, Artificial
  20-mer unique DNA sequence
caaacgccggaatcaagccc

SEQ ID NO: 784 - DNA, 20 bp, Artificial
  20-mer unique DNA sequence
ggccttcatgctacccctgg

SEQ ID NO: 785 - DNA, 20 bp, Artificial
  20-mer unique DNA sequence
tgtgattggttgtcggggcg

SEQ ID NO: 786 - DNA, 20 bp, Artificial
  20-mer unique DNA sequence
cgaggccgactaagtgctga

SEQ ID NO: 787 - DNA, 20 bp, Artificial
  20-mer unique DNA sequence
tctctcacgggtggccagaa

SEQ ID NO: 788 - DNA, 20 bp, Artificial
  20-mer unique DNA sequence
taggcccccaatcaaacccc

SEQ ID NO: 789 - DNA, 20 bp, Artificial
  20-mer unique DNA sequence
acatcatcatcgcccgctca

SEQ ID NO: 790 - DNA, 20 bp, Artificial
  20-mer unique DNA sequence
agacttcccccttccgcccc

SEQ ID NO: 791 - DNA, 20 bp, Artificial
  20-mer unique DNA sequence
ttagcccaacccgcccgatt

SEQ ID NO: 792 - DNA, 20 bp, Artificial
  20-mer unique DNA sequence
tggaaggggactaacgcggg

SEQ ID NO: 793 - DNA, 20 bp, Artificial
  20-mer unique DNA sequence
acacacgccgagaaccacga

SEQ ID NO: 794 - DNA, 20 bp, Artificial
  20-mer unique DNA sequence
cgggcgatgaggggaagtac

SEQ ID NO: 795 - DNA, 20 bp, Artificial
  20-mer unique DNA sequence
gcttgcgttgcgctgtccta

SEQ ID NO: 796 - DNA, 20 bp, Artificial
  20-mer unique DNA sequence
ccgcgttgtttggttgccgt

SEQ ID NO: 797 - DNA, 20 bp, Artificial
  20-mer unique DNA sequence
cgtggcaagggaacagggca

SEQ ID NO: 798 - DNA, 20 bp, Artificial
  20-mer unique DNA sequence
atcgtgcctttcgcctccaa

SEQ ID NO: 799 - DNA, 20 bp, Artificial
  20-mer unique DNA sequence
atgcgagacggggtggaaag

SEQ ID NO: 800 - DNA, 20 bp, Artificial
  20-mer unique DNA sequence
aattacctccccaccccaga

SEQ ID NO: 801 - DNA, 20 bp, Artificial
  20-mer unique DNA sequence
aagttggttcgcgtcggtgg

SEQ ID NO: 802 - DNA, 20 bp, Artificial
  20-mer unique DNA sequence
acgggacggggcgagttacg

SEQ ID NO: 803 - DNA, 20 bp, Artificial
  20-mer unique DNA sequence
cgctacgggcttgcaaacag

SEQ ID NO: 804 - DNA, 20 bp, Artificial
  20-mer unique DNA sequence
ccgccgcacatccaaagcta

SEQ ID NO: 805 - DNA, 20 bp, Artificial
  20-mer unique DNA sequence
ttccaaaatccaccgtcgcc

SEQ ID NO: 806 - DNA, 20 bp, Artificial
  20-mer unique DNA sequence
gctggaaactgcgggagggt

SEQ ID NO: 807 - DNA, 20 bp, Artificial
  20-mer unique DNA sequence
gcggctgagtgggtgtctcc

SEQ ID NO: 808 - DNA, 20 bp, Artificial
  20-mer unique DNA sequence
ccccttccaccctacgtccc

SEQ ID NO: 809 - DNA, 20 bp, Artificial
  20-mer unique DNA sequence
cggagacgaaacgcgcaaca

SEQ ID NO: 810 - DNA, 20 bp, Artificial
  20-mer unique DNA sequence
agcttcagccgggaacgtag

SEQ ID NO: 811 - DNA, 20 bp, Artificial
  20-mer unique DNA sequence
gtgggccgagatcagtccaa

SEQ ID NO: 812 - DNA, 20 bp, Artificial
  20-mer unique DNA sequence
caccgcccgtccaaacactt

SEQ ID NO: 813 - DNA, 20 bp, Artificial
  20-mer unique DNA sequence
gaggggtaatggggcgaacg

SEQ ID NO: 814 - DNA, 20 bp, Artificial
  20-mer unique DNA sequence
agctcttctgacggggccac

SEQ ID NO: 815 - DNA, 20 bp, Artificial
  20-mer unique DNA sequence
ccccgtcgcatggaatttga

SEQ ID NO: 816 - DNA, 20 bp, Artificial
  20-mer unique DNA sequence
tcgcgcaaggagctgtatcg

SEQ ID NO: 817 - DNA, 20 bp, Artificial
  20-mer unique DNA sequence
ccgtccccgcagcatacata

SEQ ID NO: 818 - DNA, 20 bp, Artificial
  20-mer unique DNA sequence
gggaaatggtggctgctgcg

SEQ ID NO: 819 - DNA, 20 bp, Artificial
  20-mer unique DNA sequence
ccctctgcgcccttcatcca

SEQ ID NO: 820 - DNA, 20 bp, Artificial
  20-mer unique DNA sequence
tcgttgagcaccccagcctt

SEQ ID NO: 821 - DNA, 20 bp, Artificial
  20-mer unique DNA sequence
atggttagggtcgggtgggg

SEQ ID NO: 822 - DNA, 20 bp, Artificial
  20-mer unique DNA sequence
cgcgcatacacggacaaggt

SEQ ID NO: 823 - DNA, 20 bp, Artificial
  20-mer unique DNA sequence
cctgcagcgcctatccaccc

SEQ ID NO: 824 - DNA, 20 bp, Artificial
  20-mer unique DNA sequence
ttcgtgccgtgctgtatggg

SEQ ID NO: 825 - DNA, 20 bp, Artificial
  20-mer unique DNA sequence
attgcaactgggtgggggct

SEQ ID NO: 826 - DNA, 20 bp, Artificial
  20-mer unique DNA sequence
aaggccgtgggggaatgttt

SEQ ID NO: 827 - DNA, 20 bp, Artificial
  20-mer unique DNA sequence
caaccacacccaagccccca

SEQ ID NO: 828 - DNA, 20 bp, Artificial
  20-mer unique DNA sequence
accttgccgcgttacacccc

SEQ ID NO: 829 - DNA, 20 bp, Artificial
  20-mer unique DNA sequence
tatctcaccacgccgccagc

SEQ ID NO: 830 - DNA, 20 bp, Artificial
  20-mer unique DNA sequence
gtcccctcccattcgtccct

SEQ ID NO: 831 - DNA, 20 bp, Artificial
  20-mer unique DNA sequence
gagtttcctgtcccgtgcgc

SEQ ID NO: 832 - DNA, 20 bp, Artificial
  20-mer unique DNA sequence
aaatggggggagcgcaggtg

SEQ ID NO: 833 - DNA, 20 bp, Artificial
  20-mer unique DNA sequence
gctgtttcgcttgccgccat

SEQ ID NO: 834 - DNA, 20 bp, Artificial
  20-mer unique DNA sequence
cgcctcacctctccaccacc

SEQ ID NO: 835 - DNA, 20 bp, Artificial
  20-mer unique DNA sequence
agcaagagtcggggaggcac

SEQ ID NO: 836 - DNA, 20 bp, Artificial
  20-mer unique DNA sequence
cgcaccgagagcacgacagt

SEQ ID NO: 837 - DNA, 20 bp, Artificial
  20-mer unique DNA sequence
ggggtccggctgttgatgtg

SEQ ID NO: 838 - DNA, 20 bp, Artificial
  20-mer unique DNA sequence
ctgcgcaaacgacccacatg

SEQ ID NO: 839 - DNA, 20 bp, Artificial
  20-mer unique DNA sequence
gaggcgcgtgcataccattg

SEQ ID NO: 840 - DNA, 20 bp, Artificial
  20-mer unique DNA sequence
ccacgctctccctccaccaa

SEQ ID NO: 841 - DNA, 20 bp, Artificial
  20-mer unique DNA sequence
agctactggccgagcgaagt

SEQ ID NO: 842 - DNA, 20 bp, Artificial
  20-mer unique DNA sequence
accacccgccaaaacagtcc

SEQ ID NO: 843 - DNA, 20 bp, Artificial
  20-mer unique DNA sequence
agggtcagcggaagcaaggg

SEQ ID NO: 844 - DNA, 20 bp, Artificial
  20-mer unique DNA sequence
cgccgcctgcgtcatgtatt

SEQ ID NO: 845 - DNA, 20 bp, Artificial
  20-mer unique DNA sequence
caacagtgcgtcgaagccga

SEQ ID NO: 846 - DNA, 20 bp, Artificial
  20-mer unique DNA sequence
ggcggagcgtagccgaagtt

SEQ ID NO: 847 - DNA, 20 bp, Artificial
  20-mer unique DNA sequence
tggggtcgaagagcgaggca

SEQ ID NO: 848 - DNA, 20 bp, Artificial
  20-mer unique DNA sequence
aatcggacaccaggcaccca

SEQ ID NO: 849 - DNA, 20 bp, Artificial
  20-mer unique DNA sequence
gggcatgggtggagagcagt

SEQ ID NO: 850 - DNA, 20 bp, Artificial
  20-mer unique DNA sequence
ccgactccccaaagccctgc

SEQ ID NO: 851 - DNA, 20 bp, Artificial
  20-mer unique DNA sequence
tgctcgttcgtctgtgcctg

SEQ ID NO: 852 - DNA, 20 bp, Artificial
  20-mer unique DNA sequence
ccagctcgcctccccttctt

SEQ ID NO: 853 - DNA, 20 bp, Artificial
  20-mer unique DNA sequence
atacttctccccgcgccctg

SEQ ID NO: 854 - DNA, 20 bp, Artificial
  20-mer unique DNA sequence
ttggtttgctccctcctcga

SEQ ID NO: 855 - DNA, 20 bp, Artificial
  20-mer unique DNA sequence
ggagcattcccgttgcacaa

SEQ ID NO: 856 - DNA, 20 bp, Artificial
  20-mer unique DNA sequence
agtcgccatgacccttcggt

SEQ ID NO: 857 - DNA, 20 bp, Artificial
  20-mer unique DNA sequence
agcgcccgaaaactgcacgt

SEQ ID NO: 858 - DNA, 20 bp, Artificial
  20-mer unique DNA sequence
tggacgaagcgaaaggggag

SEQ ID NO: 859 - DNA, 20 bp, Artificial
  20-mer unique DNA sequence
ttgtcgcgcgcttatctcca

SEQ ID NO: 860 - DNA, 20 bp, Artificial
  20-mer unique DNA sequence
atgacactcgcgataggccc

SEQ ID NO: 861 - DNA, 20 bp, Artificial
  20-mer unique DNA sequence
gaggggggcgattttcttcc

SEQ ID NO: 862 - DNA, 20 bp, Artificial
  20-mer unique DNA sequence
ggcctcctgcagttatcccg

SEQ ID NO: 863 - DNA, 20 bp, Artificial
  20-mer unique DNA sequence
tggtatcctctccgtgcccg

SEQ ID NO: 864 - DNA, 20 bp, Artificial
  20-mer unique DNA sequence
agggacggaggccaggatag

SEQ ID NO: 865 - DNA, 20 bp, Artificial
  20-mer unique DNA sequence
agaggggcgagcattcacgg

SEQ ID NO: 866 - DNA, 20 bp, Artificial
  20-mer unique DNA sequence
gtcagggattgtcggtgcgc

SEQ ID NO: 867 - DNA, 20 bp, Artificial
  20-mer unique DNA sequence
agagtgcgcaaaaacggggc

SEQ ID NO: 868 - DNA, 20 bp, Artificial
  20-mer unique DNA sequence
gccattttctcgggggcaca

SEQ ID NO: 869 - DNA, 20 bp, Artificial
  20-mer unique DNA sequence
accccaccctcttgcgtctg

SEQ ID NO: 870 - DNA, 20 bp, Artificial
  20-mer unique DNA sequence
attgcagctcccgcggacta

SEQ ID NO: 871 - DNA, 20 bp, Artificial
  20-mer unique DNA sequence
gcctatgagcctacggcgaa

SEQ ID NO: 872 - DNA, 20 bp, Artificial
  20-mer unique DNA sequence
cagcaaattccaggcggtgg

SEQ ID NO: 873 - DNA, 20 bp, Artificial
  20-mer unique DNA sequence
gcagcagggcttcaccgagt

SEQ ID NO: 874 - DNA, 20 bp, Artificial
  20-mer unique DNA sequence
tccataacgcagaaaacgcc

SEQ ID NO: 875 - DNA, 20 bp, Artificial
  20-mer unique DNA sequence
agcccaaaggaggacgcgaa

SEQ ID NO: 876 - DNA, 20 bp, Artificial
  20-mer unique DNA sequence
tgtggggcggattcaaaggt

SEQ ID NO: 877 - DNA, 20 bp, Artificial
  20-mer unique DNA sequence
ttgttccggcccctcgttca

SEQ ID NO: 878 - DNA, 20 bp, Artificial
  20-mer unique DNA sequence
tccagtccgacacatacggc

SEQ ID NO: 879 - DNA, 20 bp, Artificial
  20-mer unique DNA sequence
gagcgccgggtatccaatgc

SEQ ID NO: 880 - DNA, 20 bp, Artificial
  20-mer unique DNA sequence
ccagccacttttcttgcccc

SEQ ID NO: 881 - DNA, 20 bp, Artificial
  20-mer unique DNA sequence
acccggccacctagcatcaa

SEQ ID NO: 882 - DNA, 20 bp, Artificial
  20-mer unique DNA sequence
gccgcgagctcagacctaat

SEQ ID NO: 883 - DNA, 20 bp, Artificial
  20-mer unique DNA sequence
agtaaggccgacggacagtg

SEQ ID NO: 884 - DNA, 20 bp, Artificial
  20-mer unique DNA sequence
tctgcctttgggctgtcgga

SEQ ID NO: 885 - DNA, 20 bp, Artificial
  20-mer unique DNA sequence
aaggaggcacagggagcgga

SEQ ID NO: 886 - DNA, 20 bp, Artificial
  20-mer unique DNA sequence
cgaacacatccgcacgcaac

SEQ ID NO: 887 - DNA, 20 bp, Artificial
  20-mer unique DNA sequence
tcggcgttgccctttttctg

SEQ ID NO: 888 - DNA, 20 bp, Artificial
  20-mer unique DNA sequence
acaccagccccccctgtctg

SEQ ID NO: 889 - DNA, 20 bp, Artificial
  20-mer unique DNA sequence
agattcgcaccgaccccacg

SEQ ID NO: 890 - DNA, 20 bp, Artificial
  20-mer unique DNA sequence
tcaacccgtgtactgagccc

SEQ ID NO: 891 - DNA, 20 bp, Artificial
  20-mer unique DNA sequence
gtgttctacgcgagtgcggt

SEQ ID NO: 892 - DNA, 20 bp, Artificial
  20-mer unique DNA sequence
gggttcagatgtttgcgggg

SEQ ID NO: 893 - DNA, 20 bp, Artificial
  20-mer unique DNA sequence
cctcatcccccgttctgctg

SEQ ID NO: 894 - DNA, 20 bp, Artificial
  20-mer unique DNA sequence
gccgttcatgctttgtgccc

SEQ ID NO: 895 - DNA, 20 bp, Artificial
  20-mer unique DNA sequence
gtgggtggacaccgtgtgat

SEQ ID NO: 896 - DNA, 20 bp, Artificial
  20-mer unique DNA sequence
acaaatggtgcgcgtggtgc

SEQ ID NO: 897 - DNA, 20 bp, Artificial
  20-mer unique DNA sequence
gctggggttcgaggtgcttc

SEQ ID NO: 898 - DNA, 20 bp, Artificial
  20-mer unique DNA sequence
ctcttgcgacgacggaccct

SEQ ID NO: 899 - DNA, 20 bp, Artificial
  20-mer unique DNA sequence
ggggtttcgactgatgcgcg

SEQ ID NO: 900 - DNA, 20 bp, Artificial
  20-mer unique DNA sequence
ccttaacgcgccttttgtcg

SEQ ID NO: 901 - DNA, 20 bp, Artificial
  20-mer unique DNA sequence
gcctccaggacgtcaactca

SEQ ID NO: 902 - DNA, 20 bp, Artificial
  20-mer unique DNA sequence
tctgcgccatccggcttgac

SEQ ID NO: 903 - DNA, 20 bp, Artificial
  20-mer unique DNA sequence
cggaacgggctgcggtctta

SEQ ID NO: 904 - DNA, 20 bp, Artificial
  20-mer unique DNA sequence
atgatgcccgttacccctgc

SEQ ID NO: 905 - DNA, 20 bp, Artificial
  20-mer unique DNA sequence
tcacacattccccttcgcca

SEQ ID NO: 906 - DNA, 20 bp, Artificial
  20-mer unique DNA sequence
tcccaccaagcgatccacca

SEQ ID NO: 907 - DNA, 20 bp, Artificial
  20-mer unique DNA sequence
agcgggactagggtgggcat

SEQ ID NO: 908 - DNA, 20 bp, Artificial
  20-mer unique DNA sequence
gctttcgaccgtggtagcca

SEQ ID NO: 909 - DNA, 20 bp, Artificial
  20-mer unique DNA sequence
tagcgtgagatcgcggacac

SEQ ID NO: 910 - DNA, 20 bp, Artificial
  20-mer unique DNA sequence
gtgaatcgcggaaacccccc

SEQ ID NO: 911 - DNA, 20 bp, Artificial
  20-mer unique DNA sequence
gcggtttatgctttgtgccc

SEQ ID NO: 912 - DNA, 20 bp, Artificial
  20-mer unique DNA sequence
tgacctcccctttgcaccgg

SEQ ID NO: 913 - DNA, 20 bp, Artificial
  20-mer unique DNA sequence
cttagacgtcggccgagtga

SEQ ID NO: 914 - DNA, 20 bp, Artificial
  20-mer unique DNA sequence
cccccgctagtcccgttctc

SEQ ID NO: 915 - DNA, 20 bp, Artificial
  20-mer unique DNA sequence
atgaccggaagaggccccac

SEQ ID NO: 916 - DNA, 20 bp, Artificial
  20-mer unique DNA sequence
tgttccggcagggtttggct

SEQ ID NO: 917 - DNA, 20 bp, Artificial
  20-mer unique DNA sequence
gtcggtctgtcgcaaagggg

SEQ ID NO: 918 - DNA, 20 bp, Artificial
  20-mer unique DNA sequence
gtgcagcctagggtgttcct

SEQ ID NO: 919 - DNA, 20 bp, Artificial
  20-mer unique DNA sequence
tctacggcatccgtggacct

SEQ ID NO: 920 - DNA, 20 bp, Artificial
  20-mer unique DNA sequence
cacctggccgatcgttttcc

SEQ ID NO: 921 - DNA, 20 bp, Artificial
  20-mer unique DNA sequence
tcgccactacccggaaaacc

SEQ ID NO: 922 - DNA, 20 bp, Artificial
  20-mer unique DNA sequence
cccaatacgcctgccatcgc

SEQ ID NO: 923 - DNA, 20 bp, Artificial
  20-mer unique DNA sequence
gtgggggcgagcgtgttgag

SEQ ID NO: 924 - DNA, 20 bp, Artificial
  20-mer unique DNA sequence
gatctcgccgcctacaaccg

SEQ ID NO: 925 - DNA, 20 bp, Artificial
  20-mer unique DNA sequence
acgatcccagctgcacacca

SEQ ID NO: 926 - DNA, 20 bp, Artificial
  20-mer unique DNA sequence
gcaggctaggtgcagcctta

SEQ ID NO: 927 - DNA, 20 bp, Artificial
  20-mer unique DNA sequence
ccgtcaccccttgctccacc

SEQ ID NO: 928 - DNA, 20 bp, Artificial
  20-mer unique DNA sequence
gaaggcgggggattggatgt

SEQ ID NO: 929 - DNA, 20 bp, Artificial
  20-mer unique DNA sequence
cgggtttggttggcgtcatt

SEQ ID NO: 930 - DNA, 20 bp, Artificial
  20-mer unique DNA sequence
gtggggcttgggaacaaacg

SEQ ID NO: 931 - DNA, 20 bp, Artificial
  20-mer unique DNA sequence
cgcacagccccaccagaaac

SEQ ID NO: 932 - DNA, 20 bp, Artificial
  20-mer unique DNA sequence
ataaggggcagaggggcagg

SEQ ID NO: 933 - DNA, 20 bp, Artificial
  20-mer unique DNA sequence
taggccccgagcgatgcaaa

SEQ ID NO: 934 - DNA, 20 bp, Artificial
  20-mer unique DNA sequence
gctccatgctacccgaaaac

SEQ ID NO: 935 - DNA, 20 bp, Artificial
  20-mer unique DNA sequence
tgtggtttgtgggctcggat

SEQ ID NO: 936 - DNA, 20 bp, Artificial
  20-mer unique DNA sequence
gacgacaacggcaccacgaa

SEQ ID NO: 937 - DNA, 20 bp, Artificial
  20-mer unique DNA sequence
ctaatggcgtacggcgggat

SEQ ID NO: 938 - DNA, 20 bp, Artificial
  20-mer unique DNA sequence
cgggggtgggtttgaaggga

SEQ ID NO: 939 - DNA, 20 bp, Artificial
  20-mer unique DNA sequence
cgaaaccacccacgaaggcg

SEQ ID NO: 940 - DNA, 20 bp, Artificial
  20-mer unique DNA sequence
cgacaattccccagccccag

SEQ ID NO: 941 - DNA, 20 bp, Artificial
  20-mer unique DNA sequence
tcccacccagcgtcctcttt

SEQ ID NO: 942 - DNA, 20 bp, Artificial
  20-mer unique DNA sequence
cggggaacgctctggaatga

SEQ ID NO: 943 - DNA, 20 bp, Artificial
  20-mer unique DNA sequence
attgccgtgaagatgccccg

SEQ ID NO: 944 - DNA, 20 bp, Artificial
  20-mer unique DNA sequence
ccaaaatcgcgtccggccta

SEQ ID NO: 945 - DNA, 20 bp, Artificial
  20-mer unique DNA sequence
caaccgccccagaccatttt

SEQ ID NO: 946 - DNA, 20 bp, Artificial
  20-mer unique DNA sequence
cttgaatccttgcgcaccga

SEQ ID NO: 947 - DNA, 20 bp, Artificial
  20-mer unique DNA sequence
atcactccggccagcattcg

SEQ ID NO: 948 - DNA, 20 bp, Artificial
  20-mer unique DNA sequence
caaaagcgaaaaccgggcag

SEQ ID NO: 949 - DNA, 20 bp, Artificial
  20-mer unique DNA sequence
ctattgggttcgcggcaggg

SEQ ID NO: 950 - DNA, 20 bp, Artificial
  20-mer unique DNA sequence
gtatgggacggcggaagtgg

SEQ ID NO: 951 - DNA, 20 bp, Artificial
  20-mer unique DNA sequence
ccgcctcattgccctatcgt

SEQ ID NO: 952 - DNA, 20 bp, Artificial
  20-mer unique DNA sequence
cgccccatttagccgaacga

SEQ ID NO: 953 - DNA, 20 bp, Artificial
  20-mer unique DNA sequence
ggcactttcgtggcggggtt

SEQ ID NO: 954 - DNA, 20 bp, Artificial
  20-mer unique DNA sequence
tcccacgcaagcccatcaaa

SEQ ID NO: 955 - DNA, 20 bp, Artificial
  20-mer unique DNA sequence
aaaaaaggcagcgcgagacc

SEQ ID NO: 956 - DNA, 20 bp, Artificial
  20-mer unique DNA sequence
accgaaatgacgaccccccc

SEQ ID NO: 957 - DNA, 20 bp, Artificial
  20-mer unique DNA sequence
ggattgggcccgtctctgag

SEQ ID NO: 958 - DNA, 20 bp, Artificial
  20-mer unique DNA sequence
ccgccccctacgcaatcaag

SEQ ID NO: 959 - DNA, 20 bp, Artificial
  20-mer unique DNA sequence
tatggggagcacgaccggga

SEQ ID NO: 960 - DNA, 20 bp, Artificial
  20-mer unique DNA sequence
gcacccctcggcaccatatt

SEQ ID NO: 961 - DNA, 20 bp, Artificial
  20-mer unique DNA sequence
gttcaaggtcggtttgtgca

SEQ ID NO: 962 - DNA, 20 bp, Artificial
  20-mer unique DNA sequence
cccggtgtatgcgcttttcc

SEQ ID NO: 963 - DNA, 20 bp, Artificial
  20-mer unique DNA sequence
gggtcggcctggaagatgtg

SEQ ID NO: 964 - DNA, 20 bp, Artificial
  20-mer unique DNA sequence
tacgacaacgggccatgcaa

SEQ ID NO: 965 - DNA, 20 bp, Artificial
  20-mer unique DNA sequence
ggcccgtcgcagctgtcatt

SEQ ID NO: 966 - DNA, 20 bp, Artificial
  20-mer unique DNA sequence
ccacgtccgccccctgtaat

SEQ ID NO: 967 - DNA, 20 bp, Artificial
  20-mer unique DNA sequence
gggtacagtgggcttggggg

SEQ ID NO: 968 - DNA, 20 bp, Artificial
  20-mer unique DNA sequence
tccacccgatctccaccgtt

SEQ ID NO: 969 - DNA, 20 bp, Artificial
  20-mer unique DNA sequence
ggcaggcattttacggtcgg

SEQ ID NO: 970 - DNA, 20 bp, Artificial
  20-mer unique DNA sequence
gcagtgggcgagagagcgga

SEQ ID NO: 971 - DNA, 20 bp, Artificial
  20-mer unique DNA sequence
tcccaagccggtcaaagcga

SEQ ID NO: 972 - DNA, 20 bp, Artificial
  20-mer unique DNA sequence
tggagggaggtgcgtgatgc

SEQ ID NO: 973 - DNA, 20 bp, Artificial
  20-mer unique DNA sequence
atggggatcacaagggctgc

SEQ ID NO: 974 - DNA, 20 bp, Artificial
  20-mer unique DNA sequence
acattagccagaccccccgc

SEQ ID NO: 975 - DNA, 20 bp, Artificial
  20-mer unique DNA sequence
aggtgcgtggcgaggttgga

SEQ ID NO: 976 - DNA, 20 bp, Artificial
  20-mer unique DNA sequence
agtcacgggaggtcttgggc

SEQ ID NO: 977 - DNA, 20 bp, Artificial
  20-mer unique DNA sequence
gggcgtggggatgaaaggag

SEQ ID NO: 978 - DNA, 20 bp, Artificial
  20-mer unique DNA sequence
agttggttcgtgcggatggg

SEQ ID NO: 979 - DNA, 20 bp, Artificial
  20-mer unique DNA sequence
aacccctacccgccgccaat

SEQ ID NO: 980 - DNA, 20 bp, Artificial
  20-mer unique DNA sequence
ccatcagtacagcccgcccg

SEQ ID NO: 981 - DNA, 20 bp, Artificial
  20-mer unique DNA sequence
ccggctccccatcctttgtc

SEQ ID NO: 982 - DNA, 20 bp, Artificial
  20-mer unique DNA sequence
gattagggagcgcggggagg

SEQ ID NO: 983 - DNA, 20 bp, Artificial
  20-mer unique DNA sequence
ttccaccacctgccaccaaa

SEQ ID NO: 984 - DNA, 20 bp, Artificial
  20-mer unique DNA sequence
aaagggtcggggggatatcg

SEQ ID NO: 985 - DNA, 20 bp, Artificial
  20-mer unique DNA sequence
gggaaggatgggtgcgtttg

SEQ ID NO: 986 - DNA, 20 bp, Artificial
  20-mer unique DNA sequence
tgtctgcatggaagccggga

SEQ ID NO: 987 - DNA, 20 bp, Artificial
  20-mer unique DNA sequence
ctagcaaagaacgggggcgg

SEQ ID NO: 988 - DNA, 20 bp, Artificial
  20-mer unique DNA sequence
acccgcccccagaccaaata

SEQ ID NO: 989 - DNA, 20 bp, Artificial
  20-mer unique DNA sequence
tgccgtgggcttgagttcgt

SEQ ID NO: 990 - DNA, 20 bp, Artificial
  20-mer unique DNA sequence
tccttcttccggcgcctatg

SEQ ID NO: 991 - DNA, 20 bp, Artificial
  20-mer unique DNA sequence
ccgagaaggggccaaatacg

SEQ ID NO: 992 - DNA, 20 bp, Artificial
  20-mer unique DNA sequence
gcgcgacggagaatgtgatg

SEQ ID NO: 993 - DNA, 20 bp, Artificial
  20-mer unique DNA sequence
ccatagacagaagggccgcg

SEQ ID NO: 994 - DNA, 20 bp, Artificial
  20-mer unique DNA sequence
tatgccgcctctcttccgct

SEQ ID NO: 995 - DNA, 20 bp, Artificial
  20-mer unique DNA sequence
tccgatgttgtgaggaggcg

SEQ ID NO: 996 - DNA, 20 bp, Artificial
  20-mer unique DNA sequence
acggaagtacgggggggcag

SEQ ID NO: 997 - DNA, 20 bp, Artificial
  20-mer unique DNA sequence
atgacgtcggcggtgttcca

SEQ ID NO: 998 - DNA, 20 bp, Artificial
  20-mer unique DNA sequence
ccccgaccaccgaaaacgag

SEQ ID NO: 999 - DNA, 20 bp, Artificial
  20-mer unique DNA sequence
cggcgagcaaggcataggga

SEQ ID NO: 1000 - DNA, 20 bp, Artificial
  20-mer unique DNA sequence
atgacggtcggcgtactgga

SEQ ID NO: 1001 - DNA, 20 bp, Artificial
  20-mer unique DNA sequence
gagcacggggtctcacgtat

SEQ ID NO: 1002 - DNA, 20 bp, Artificial
  20-mer unique DNA sequence
ccactccttccgtatcccgc

SEQ ID NO: 1003 - DNA, 20 bp, Artificial
  20-mer unique DNA sequence
gataaaagcgcgggccaacc

SEQ ID NO: 1004 - DNA, 20 bp, Artificial
  20-mer unique DNA sequence
ggcaatcatggggcgcaaac

SEQ ID NO: 1005 - DNA, 20 bp, Artificial
  20-mer unique DNA sequence
acgtaacaggaccgctggtg

SEQ ID NO: 1006 - DNA, 20 bp, Artificial
  20-mer unique DNA sequence
accatcctccccccctcgtc

SEQ ID NO: 1007 - DNA, 20 bp, Artificial
  20-mer unique DNA sequence
aatggcacggaagaccgcaa

SEQ ID NO: 1008 - DNA, 20 bp, Artificial
  20-mer unique DNA sequence
acgggtcctcagatccgtct

SEQ ID NO: 1009 - DNA, 20 bp, Artificial
  20-mer unique DNA sequence
aaacagtctggtcgcacgga

SEQ ID NO: 1010 - DNA, 20 bp, Artificial
  20-mer unique DNA sequence
gctccgggggtctgccataa

SEQ ID NO: 1011 - DNA, 20 bp, Artificial
  20-mer unique DNA sequence
ccgggacggtggttgaagat

SEQ ID NO: 1012 - DNA, 20 bp, Artificial
  20-mer unique DNA sequence
atccgccagacattcccacg

SEQ ID NO: 1013 - DNA, 20 bp, Artificial
  20-mer unique DNA sequence
agtggcggggttgcgttagg

SEQ ID NO: 1014 - DNA, 20 bp, Artificial
  20-mer unique DNA sequence
cgctcgggtgcgctacatta

SEQ ID NO: 1015 - DNA, 20 bp, Artificial
  20-mer unique DNA sequence
tcccgcgcggtctagttaca

SEQ ID NO: 1016 - DNA, 20 bp, Artificial
  20-mer unique DNA sequence
aggccccgtgttgtttgcgg

SEQ ID NO: 1017 - DNA, 20 bp, Artificial
  20-mer unique DNA sequence
cacccccgcctgctgatctc

SEQ ID NO: 1018 - DNA, 20 bp, Artificial
  20-mer unique DNA sequence
aagtcgtggcgggaggcaac

SEQ ID NO: 1019 - DNA, 20 bp, Artificial
  20-mer unique DNA sequence
cgccgctctacccctttcag

SEQ ID NO: 1020 - DNA, 20 bp, Artificial
  20-mer unique DNA sequence
gcgtgtgtgtcctgcttggg

SEQ ID NO: 1021 - DNA, 20 bp, Artificial
  20-mer unique DNA sequence
ccgtccgtctttgcctgtcg

SEQ ID NO: 1022 - DNA, 20 bp, Artificial
  20-mer unique DNA sequence
gggctatcgttggtgtgggc

SEQ ID NO: 1023 - DNA, 20 bp, Artificial
  20-mer unique DNA sequence
agaggcggggctaggtccaa

SEQ ID NO: 1024 - DNA, 20 bp, Artificial
  20-mer unique DNA sequence
caggcgcaaaggtaccacgg

SEQ ID NO: 1025 - DNA, 20 bp, Artificial
  20-mer unique DNA sequence
cgcctatccacgcccatcct

SEQ ID NO: 1026 - DNA, 20 bp, Artificial
  20-mer unique DNA sequence
ccggccatgaggtgtcgttt

SEQ ID NO: 1027 - DNA, 20 bp, Artificial
  20-mer unique DNA sequence
ggcccgtggaggattcattg

SEQ ID NO: 1028 - DNA, 20 bp, Artificial
  20-mer unique DNA sequence
atctcaccccgcaggccatt

SEQ ID NO: 1029 - DNA, 20 bp, Artificial
  20-mer unique DNA sequence
aagcacggcgggaaattgat

SEQ ID NO: 1030 - DNA, 20 bp, Artificial
  20-mer unique DNA sequence
ccgtcactccccctcgaatc

SEQ ID NO: 1031 - DNA, 20 bp, Artificial
  20-mer unique DNA sequence
ttggcccccgtgcttctctt

SEQ ID NO: 1032 - DNA, 20 bp, Artificial
  20-mer unique DNA sequence
cgcaacggccggtagaatgt

SEQ ID NO: 1033 - DNA, 20 bp, Artificial
  20-mer unique DNA sequence
caagactcgctaaccgccgc

SEQ ID NO: 1034 - DNA, 20 bp, Artificial
  20-mer unique DNA sequence
cgacagccccaagcccctaa

SEQ ID NO: 1035 - DNA, 20 bp, Artificial
  20-mer unique DNA sequence
gttgacaggggtcggtggcg

SEQ ID NO: 1036 - DNA, 20 bp, Artificial
  20-mer unique DNA sequence
gtcaaagccccccgcaatgt

SEQ ID NO: 1037 - DNA, 20 bp, Artificial
  20-mer unique DNA sequence
gcctcctcctattgcgctcg

SEQ ID NO: 1038 - DNA, 20 bp, Artificial
  20-mer unique DNA sequence
cggggcctgtctcgtgctgt

SEQ ID NO: 1039 - DNA, 20 bp, Artificial
  20-mer unique DNA sequence
gagcacccgtaaggcccatg

SEQ ID NO: 1040 - DNA, 20 bp, Artificial
  20-mer unique DNA sequence
cgaccccccgtgagcaacta

SEQ ID NO: 1041 - DNA, 20 bp, Artificial
  20-mer unique DNA sequence
acatgacttgcgccggtgac

SEQ ID NO: 1042 - DNA, 20 bp, Artificial
  20-mer unique DNA sequence
gcggcgtggggtgattctgt

SEQ ID NO: 1043 - DNA, 20 bp, Artificial
  20-mer unique DNA sequence
agtggatgtgggggagcgac

SEQ ID NO: 1044 - DNA, 20 bp, Artificial
  20-mer unique DNA sequence
cggatggtgtgcaactgggg

SEQ ID NO: 1045 - DNA, 20 bp, Artificial
  20-mer unique DNA sequence
gtcctccgtgcgcttgttgc

SEQ ID NO: 1046 - DNA, 20 bp, Artificial
  20-mer unique DNA sequence
tccacgcggcactcactctt

SEQ ID NO: 1047 - DNA, 20 bp, Artificial
  20-mer unique DNA sequence
ccgagtggccgaagcaaacg

SEQ ID NO: 1048 - DNA, 20 bp, Artificial
  20-mer unique DNA sequence
tcccggggtagtttgtggca

SEQ ID NO: 1049 - DNA, 20 bp, Artificial
  20-mer unique DNA sequence
atgcgtgagggggatgaacc

SEQ ID NO: 1050 - DNA, 20 bp, Artificial
  20-mer unique DNA sequence
tagcttgtgggacctgcgga

SEQ ID NO: 1051 - DNA, 20 bp, Artificial
  20-mer unique DNA sequence
tgacctgagatacgccgccg

SEQ ID NO: 1052 - DNA, 20 bp, Artificial
  20-mer unique DNA sequence
ccccccacggtcttcatgtt

SEQ ID NO: 1053 - DNA, 20 bp, Artificial
  20-mer unique DNA sequence
cccgttgttatgagcgccct

SEQ ID NO: 1054 - DNA, 20 bp, Artificial
  20-mer unique DNA sequence
cagctcttcgttgcgcggtt

SEQ ID NO: 1055 - DNA, 20 bp, Artificial
  20-mer unique DNA sequence
aggggctcgtcttcttcgcg

SEQ ID NO: 1056 - DNA, 20 bp, Artificial
  20-mer unique DNA sequence
cactcacctccgcggcaagc

SEQ ID NO: 1057 - DNA, 20 bp, Artificial
  20-mer unique DNA sequence
agggtgaagtggtcggtcgg

SEQ ID NO: 1058 - DNA, 20 bp, Artificial
  20-mer unique DNA sequence
taagggtgagggcagggcga

SEQ ID NO: 1059 - DNA, 20 bp, Artificial
  20-mer unique DNA sequence
ggatccgcccaccctattcg

SEQ ID NO: 1060 - DNA, 20 bp, Artificial
  20-mer unique DNA sequence
ccgggggtgggcttagagga

SEQ ID NO: 1061 - DNA, 20 bp, Artificial
  20-mer unique DNA sequence
ggatcggactggcgtaggcg

SEQ ID NO: 1062 - DNA, 20 bp, Artificial
  20-mer unique DNA sequence
ggggctagggatggaccggt

SEQ ID NO: 1063 - DNA, 20 bp, Artificial
  20-mer unique DNA sequence
ccgcaaccgcacatccacag

SEQ ID NO: 1064 - DNA, 20 bp, Artificial
  20-mer unique DNA sequence
tttttccaagctccccgcct

SEQ ID NO: 1065 - DNA, 20 bp, Artificial
  20-mer unique DNA sequence
cgcattggtgttgagggggt

SEQ ID NO: 1066 - DNA, 20 bp, Artificial
  20-mer unique DNA sequence
gatccgcacagaacctcgcc

SEQ ID NO: 1067 - DNA, 20 bp, Artificial
  20-mer unique DNA sequence
tccatgacaagcgctccccg

SEQ ID NO: 1068 - DNA, 20 bp, Artificial
  20-mer unique DNA sequence
tgtagcaataacgcgcccgg

SEQ ID NO: 1069 - DNA, 20 bp, Artificial
  20-mer unique DNA sequence
cacgtgccgtagtcaggctt

SEQ ID NO: 1070 - DNA, 20 bp, Artificial
  20-mer unique DNA sequence
agggatgcgagggacacagg

SEQ ID NO: 1071 - DNA, 20 bp, Artificial
  20-mer unique DNA sequence
ggacgggtatgcttgttggc

SEQ ID NO: 1072 - DNA, 20 bp, Artificial
  20-mer unique DNA sequence
gggacgaaggccgaacaatg

SEQ ID NO: 1073 - DNA, 20 bp, Artificial
  20-mer unique DNA sequence
tacctgtgtgggcgtgggac

SEQ ID NO: 1074 - DNA, 20 bp, Artificial
  20-mer unique DNA sequence
gatgggcggaattgagggga

SEQ ID NO: 1075 - DNA, 20 bp, Artificial
  20-mer unique DNA sequence
gcagatgaggcgaccggaag

SEQ ID NO: 1076 - DNA, 20 bp, Artificial
  20-mer unique DNA sequence
ctgtgctgtgccccggtatg

SEQ ID NO: 1077 - DNA, 20 bp, Artificial
  20-mer unique DNA sequence
agtcgcgcgggtagaagggg

SEQ ID NO: 1078 - DNA, 20 bp, Artificial
  20-mer unique DNA sequence
cgggcggtgcaggtgttagt

SEQ ID NO: 1079 - DNA, 20 bp, Artificial
  20-mer unique DNA sequence
tgggtgatcttcgtgccgtc

SEQ ID NO: 1080 - DNA, 20 bp, Artificial
  20-mer unique DNA sequence
cgggcggtgcaggtgttagt

SEQ ID NO: 1081 - DNA, 20 bp, Artificial
  20-mer unique DNA sequence
tgggtgatcttcgtgccgtc

SEQ ID NO: 1082 - DNA, 20 bp, Artificial
  20-mer unique DNA sequence
gccccccgtgcatgaaagat

SEQ ID NO: 1083 - DNA, 20 bp, Artificial
  20-mer unique DNA sequence
tgccacaccaccgccatgag

SEQ ID NO: 1084 - DNA, 20 bp, Artificial
  20-mer unique DNA sequence
accacgccacctcgcccttc

SEQ ID NO: 1085 - DNA, 20 bp, Artificial
  20-mer unique DNA sequence
aaagggcggagggcggagat

SEQ ID NO: 1086 - DNA, 20 bp, Artificial
  20-mer unique DNA sequence
tttttggtcttccccgcacg

SEQ ID NO: 1087 - DNA, 20 bp, Artificial
  20-mer unique DNA sequence
ttaacgtcagccacccccgg

SEQ ID NO: 1088 - DNA, 20 bp, Artificial
  20-mer unique DNA sequence
gtacgaaggggcccgggaaa

SEQ ID NO: 1089 - DNA, 20 bp, Artificial
  20-mer unique DNA sequence
gcgggcggatttgtcttgaa

SEQ ID NO: 1090 - DNA, 20 bp, Artificial
  20-mer unique DNA sequence
cccaaatacccgaccgcaac

SEQ ID NO: 1091 - DNA, 20 bp, Artificial
  20-mer unique DNA sequence
cgtctcccctttcgcgcctt

SEQ ID NO: 1092 - DNA, 20 bp, Artificial
  20-mer unique DNA sequence
gatgggcgcttttcacgatt

SEQ ID NO: 1093 - DNA, 20 bp, Artificial
  20-mer unique DNA sequence
aactgatgataccgcggggg

SEQ ID NO: 1094 - DNA, 20 bp, Artificial
  20-mer unique DNA sequence
ggggtgacgtcgattggggt

SEQ ID NO: 1095 - DNA, 20 bp, Artificial
  20-mer unique DNA sequence
tcccgtcgtttctccacccc

SEQ ID NO: 1096 - DNA, 20 bp, Artificial
  20-mer unique DNA sequence
gccgcaccccccatgtactg

SEQ ID NO: 1097 - DNA, 20 bp, Artificial
  20-mer unique DNA sequence
gtggggcgctggaaaggatg

SEQ ID NO: 1098 - DNA, 20 bp, Artificial
  20-mer unique DNA sequence
ctccgctcctcccgtctcag

SEQ ID NO: 1099 - DNA, 20 bp, Artificial
  20-mer unique DNA sequence
cgcaaagacgcaaggagcag

SEQ ID NO: 1100 - DNA, 20 bp, Artificial
  20-mer unique DNA sequence
cttgcgctgcacgttctggg

SEQ ID NO: 1101 - DNA, 20 bp, Artificial
  20-mer unique DNA sequence
gcctgcatgaccgcgaataa

SEQ ID NO: 1102 - DNA, 20 bp, Artificial
  20-mer unique DNA sequence
ttcccgtcctgcgtttgcgt

SEQ ID NO: 1103 - DNA, 20 bp, Artificial
  20-mer unique DNA sequence
agggggaggatcttgggcat

SEQ ID NO: 1104 - DNA, 20 bp, Artificial
  20-mer unique DNA sequence
ggccctgtcgcgtagtttcg

SEQ ID NO: 1105 - DNA, 20 bp, Artificial
  20-mer unique DNA sequence
tgaaaaatgcgggggctggt

SEQ ID NO: 1106 - DNA, 20 bp, Artificial
  20-mer unique DNA sequence
gatatggcgcgtccgcagta

SEQ ID NO: 1107 - DNA, 20 bp, Artificial
  20-mer unique DNA sequence
atgggacccgtgtgagagca

SEQ ID NO: 1108 - DNA, 20 bp, Artificial
  20-mer unique DNA sequence
gtcgctcttatcgctggccc

SEQ ID NO: 1109 - DNA, 20 bp, Artificial
  20-mer unique DNA sequence
aattcttgccacctgcgggg

SEQ ID NO: 1110 - DNA, 20 bp, Artificial
  20-mer unique DNA sequence
ccaagggcgccaagttcaac

SEQ ID NO: 1111 - DNA, 20 bp, Artificial
  20-mer unique DNA sequence
ttgggtacctgcgccatccg

SEQ ID NO: 1112 - DNA, 20 bp, Artificial
  20-mer unique DNA sequence
tacggtggcaagggtggatt

SEQ ID NO: 1113 - DNA, 20 bp, Artificial
  20-mer unique DNA sequence
tcaatcccgcccagactcca

SEQ ID NO: 1114 - DNA, 20 bp, Artificial
  20-mer unique DNA sequence
gaaatgcgtgatggggcaaa

SEQ ID NO: 1115 - DNA, 20 bp, Artificial
  20-mer unique DNA sequence
ggctcgtgctggcggtttag

SEQ ID NO: 1116 - DNA, 20 bp, Artificial
  20-mer unique DNA sequence
cctccggtcgctgtcctcct

SEQ ID NO: 1117 - DNA, 20 bp, Artificial
  20-mer unique DNA sequence
ctctttccctcccctgccat

SEQ ID NO: 1118 - DNA, 20 bp, Artificial
  20-mer unique DNA sequence
tcccgggcgtgcacactttc

SEQ ID NO: 1119 - DNA, 20 bp, Artificial
  20-mer unique DNA sequence
gagccggcctttggtatccc

SEQ ID NO: 1120 - DNA, 20 bp, Artificial
  20-mer unique DNA sequence
agcacggatgggggtttttg

SEQ ID NO: 1121 - DNA, 20 bp, Artificial
  20-mer unique DNA sequence
gcggggggtgggagtgatgt

SEQ ID NO: 1122 - DNA, 20 bp, Artificial
  20-mer unique DNA sequence
ttgcacatctttccccgcca

SEQ ID NO: 1123 - DNA, 20 bp, Artificial
  20-mer unique DNA sequence
agggagggaagatgcgcgtt

SEQ ID NO: 1124 - DNA, 20 bp, Artificial
  20-mer unique DNA sequence
ttttggtcgttcggtcgctg

SEQ ID NO: 1125 - DNA, 20 bp, Artificial
  20-mer unique DNA sequence
acagcccacaaacagcccca

SEQ ID NO: 1126 - DNA, 20 bp, Artificial
  20-mer unique DNA sequence
accgcgcagaggcatttgtt

SEQ ID NO: 1127 - DNA, 20 bp, Artificial
  20-mer unique DNA sequence
tcggatgaggactgtggcgc

SEQ ID NO: 1128 - DNA, 20 bp, Artificial
  20-mer unique DNA sequence
gcgtggcggaggaattgcaa

SEQ ID NO: 1129 - DNA, 20 bp, Artificial
  20-mer unique DNA sequence
ggggaaggggaaaggccagg

SEQ ID NO: 1130 - DNA, 20 bp, Artificial
  20-mer unique DNA sequence
agccaacagcagacggaaca

SEQ ID NO: 1131 - DNA, 20 bp, Artificial
  20-mer unique DNA sequence
cacacccttcaccgcgcaca

SEQ ID NO: 1132 - DNA, 20 bp, Artificial
  20-mer unique DNA sequence
gacagggccataccgtggtt

SEQ ID NO: 1133 - DNA, 20 bp, Artificial
  20-mer unique DNA sequence
accgtctgtgacctacggct

SEQ ID NO: 1134 - DNA, 20 bp, Artificial
  20-mer unique DNA sequence
aaacgcggacgagcaaaccc

SEQ ID NO: 1135 - DNA, 20 bp, Artificial
  20-mer unique DNA sequence
gcgcgcaacaacgaaaccac

SEQ ID NO: 1136 - DNA, 20 bp, Artificial
  20-mer unique DNA sequence
agatcctgctccaacccccc

SEQ ID NO: 1137 - DNA, 20 bp, Artificial
  20-mer unique DNA sequence
gcatgggaaagttgggcgga

SEQ ID NO: 1138 - DNA, 20 bp, Artificial
  20-mer unique DNA sequence
gctggctggcggttggacac

SEQ ID NO: 1139 - DNA, 20 bp, Artificial
  20-mer unique DNA sequence
gtcccctatccgcggtcctt

SEQ ID NO: 1140 - DNA, 20 bp, Artificial
  20-mer unique DNA sequence
cttttgggcctgcgcgagtc

SEQ ID NO: 1141 - DNA, 20 bp, Artificial
  20-mer unique DNA sequence
gaccgggatgggggctgttc

SEQ ID NO: 1142 - DNA, 20 bp, Artificial
  20-mer unique DNA sequence
cgggctccccccataagaca

SEQ ID NO: 1143 - DNA, 20 bp, Artificial
  20-mer unique DNA sequence
cgctacgagtcactgcgttg

SEQ ID NO: 1144 - DNA, 20 bp, Artificial
  20-mer unique DNA sequence
tccgtcgccccaacaatgat

SEQ ID NO: 1145 - DNA, 20 bp, Artificial
  20-mer unique DNA sequence
ttcctcagcccctcctcgtg

SEQ ID NO: 1146 - DNA, 20 bp, Artificial
  20-mer unique DNA sequence
ccgcactcccttaccgcacc

SEQ ID NO: 1147 - DNA, 20 bp, Artificial
  20-mer unique DNA sequence
ccacgcacacaaaggcacgg

SEQ ID NO: 1148 - DNA, 20 bp, Artificial
  20-mer unique DNA sequence
tattaagccccgaagccgcc

SEQ ID NO: 1149 - DNA, 20 bp, Artificial
  20-mer unique DNA sequence
ttccccagcaaagtcacccc

SEQ ID NO: 1150 - DNA, 20 bp, Artificial
  20-mer unique DNA sequence
atcagaatggcaaagggcga

SEQ ID NO: 1151 - DNA, 20 bp, Artificial
  20-mer unique DNA sequence
ttggcccgcttttacccgag

SEQ ID NO: 1152 - DNA, 20 bp, Artificial
  20-mer unique DNA sequence
cctggggagatggggtttgg

SEQ ID NO: 1153 - DNA, 20 bp, Artificial
  20-mer unique DNA sequence
atcaagaccccgcgcagaac

SEQ ID NO: 1154 - DNA, 20 bp, Artificial
  20-mer unique DNA sequence
tctctcgcctccacttgcca

SEQ ID NO: 1155 - DNA, 20 bp, Artificial
  20-mer unique DNA sequence
aggcgtaggcgagacaggga

SEQ ID NO: 1156 - DNA, 20 bp, Artificial
  20-mer unique DNA sequence
cggggggttaatcagcgtgc

SEQ ID NO: 1157 - DNA, 20 bp, Artificial
  20-mer unique DNA sequence
tctttttcatggtggcggcg

SEQ ID NO: 1158 - DNA, 20 bp, Artificial
  20-mer unique DNA sequence
gatggggcctttgtccgtgg

SEQ ID NO: 1159 - DNA, 20 bp, Artificial
  20-mer unique DNA sequence
cgttgcggccatgctgtttg

SEQ ID NO: 1160 - DNA, 20 bp, Artificial
  20-mer unique DNA sequence
aaacccgacccttccatccc

SEQ ID NO: 1161 - DNA, 20 bp, Artificial
  20-mer unique DNA sequence
tcccgccccttttgaagcct

SEQ ID NO: 1162 - DNA, 20 bp, Artificial
  20-mer unique DNA sequence
tgtgaacaagtagcccgcca

SEQ ID NO: 1163 - DNA, 20 bp, Artificial
  20-mer unique DNA sequence
gcgcgcacgatggatagagg

SEQ ID NO: 1164 - DNA, 20 bp, Artificial
  20-mer unique DNA sequence
ctgatgtggagagcggcgaa

SEQ ID NO: 1165 - DNA, 20 bp, Artificial
  20-mer unique DNA sequence
accccctcccgattgcttgt

SEQ ID NO: 1166 - DNA, 20 bp, Artificial
  20-mer unique DNA sequence
tttgtgatggggcgttttcg

SEQ ID NO: 1167 - DNA, 20 bp, Artificial
  20-mer unique DNA sequence
attccccccttgcgtatggc

SEQ ID NO: 1168 - DNA, 20 bp, Artificial
  20-mer unique DNA sequence
accgatgcgctcgctgagat

SEQ ID NO: 1169 - DNA, 20 bp, Artificial
  20-mer unique DNA sequence
tctccacctctttccgcggc

SEQ ID NO: 1170 - DNA, 20 bp, Artificial
  20-mer unique DNA sequence
gcgggttatgtggttgccga

SEQ ID NO: 1171 - DNA, 20 bp, Artificial
  20-mer unique DNA sequence
cgcccaccctcttgcctcag

SEQ ID NO: 1172 - DNA, 20 bp, Artificial
  20-mer unique DNA sequence
cccgtctcgccccaacctgt

SEQ ID NO: 1173 - DNA, 20 bp, Artificial
  20-mer unique DNA sequence
cgtccgtccgccccataagt

SEQ ID NO: 1174 - DNA, 20 bp, Artificial
  20-mer unique DNA sequence
cagaacgggcggacgagatg

SEQ ID NO: 1175 - DNA, 20 bp, Artificial
  20-mer unique DNA sequence
tgttattccgaagcgcgcag

SEQ ID NO: 1176 - DNA, 20 bp, Artificial
  20-mer unique DNA sequence
gcgcggcacgtaatccatca

SEQ ID NO: 1177 - DNA, 20 bp, Artificial
  20-mer unique DNA sequence
tcacctgttggcggcatcct

SEQ ID NO: 1178 - DNA, 20 bp, Artificial
  20-mer unique DNA sequence
actcgctcactgccccctgc

SEQ ID NO: 1179 - DNA, 20 bp, Artificial
  20-mer unique DNA sequence
ttccgccaccacacgaggct

SEQ ID NO: 1180 - DNA, 20 bp, Artificial
  20-mer unique DNA sequence
cccacccaataccagcgcca

SEQ ID NO: 1181 - DNA, 20 bp, Artificial
  20-mer unique DNA sequence
ggcaccactcacaccatcgc

SEQ ID NO: 1182 - DNA, 20 bp, Artificial
  20-mer unique DNA sequence
attctgcgggagagcttgcc

SEQ ID NO: 1183 - DNA, 20 bp, Artificial
  20-mer unique DNA sequence
ccatgccatctgagcccaaa

SEQ ID NO: 1184 - DNA, 20 bp, Artificial
  20-mer unique DNA sequence
ccgatactcaaagggcccgc

SEQ ID NO: 1185 - DNA, 20 bp, Artificial
  20-mer unique DNA sequence
cgggggtagtggttgccttg

SEQ ID NO: 1186 - DNA, 20 bp, Artificial
  20-mer unique DNA sequence
cagaacgcatccgcccgaac

SEQ ID NO: 1187 - DNA, 20 bp, Artificial
  20-mer unique DNA sequence
gactgcggtgggggggctaa

SEQ ID NO: 1188 - DNA, 20 bp, Artificial
  20-mer unique DNA sequence
ccaccgacaacgaccctcct

SEQ ID NO: 1189 - DNA, 20 bp, Artificial
  20-mer unique DNA sequence
cgtccgcaactcccttctcc

SEQ ID NO: 1190 - DNA, 20 bp, Artificial
  20-mer unique DNA sequence
aagcacctccaacatcggcc

SEQ ID NO: 1191 - DNA, 20 bp, Artificial
  20-mer unique DNA sequence
cagcgcaaacaacgggcaaa

SEQ ID NO: 1192 - DNA, 20 bp, Artificial
  20-mer unique DNA sequence
caccagcaaatcgccgcctc

SEQ ID NO: 1193 - DNA, 20 bp, Artificial
  20-mer unique DNA sequence
gcatgtaggcgggggtcgtc

SEQ ID NO: 1194 - DNA, 20 bp, Artificial
  20-mer unique DNA sequence
tcggtgagaagggcgtgagc

SEQ ID NO: 1195 - DNA, 20 bp, Artificial
  20-mer unique DNA sequence
gcgtacagcgggaatggcct

SEQ ID NO: 1196 - DNA, 20 bp, Artificial
  20-mer unique DNA sequence
ctgcgcggtatcgaggagtg

SEQ ID NO: 1197 - DNA, 20 bp, Artificial
  20-mer unique DNA sequence
acgaccgacgccactttgtg

SEQ ID NO: 1198 - DNA, 20 bp, Artificial
  20-mer unique DNA sequence
gccaacatgcaccaacccac

SEQ ID NO: 1199 - DNA, 20 bp, Artificial
  20-mer unique DNA sequence
tacatgttgcgcgtgggagc

SEQ ID NO: 1200 - DNA, 20 bp, Artificial
  20-mer unique DNA sequence
tctgcaacgctcccgacatc

SEQ ID NO: 1201 - DNA, 20 bp, Artificial
  20-mer unique DNA sequence
gctcggtaggcgggtttgcc

SEQ ID NO: 1202 - DNA, 20 bp, Artificial
  20-mer unique DNA sequence
ctacccccgccagcaaatcc

SEQ ID NO: 1203 - DNA, 20 bp, Artificial
  20-mer unique DNA sequence
tcgcataggccactgagtcc

SEQ ID NO: 1204 - DNA, 20 bp, Artificial
  20-mer unique DNA sequence
aaacggaactcttcgcccgc

SEQ ID NO: 1205 - DNA, 20 bp, Artificial
  20-mer unique DNA sequence
ctgcgcgactcccctcgaac

SEQ ID NO: 1206 - DNA, 20 bp, Artificial
  20-mer unique DNA sequence
ggaccttcatgccctctgcc

SEQ ID NO: 1207 - DNA, 20 bp, Artificial
  20-mer unique DNA sequence
ctcgcctcatagcccaaccc

SEQ ID NO: 1208 - DNA, 20 bp, Artificial
  20-mer unique DNA sequence
agcgtactcgctgacagtcc

SEQ ID NO: 1209 - DNA, 20 bp, Artificial
  20-mer unique DNA sequence
ttacctagggccccgggaaa

SEQ ID NO: 1210 - DNA, 20 bp, Artificial
  20-mer unique DNA sequence
gtctcgccccgttgtccctt

SEQ ID NO: 1211 - DNA, 20 bp, Artificial
  20-mer unique DNA sequence
gtaacactatgcccaccccg

SEQ ID NO: 1212 - DNA, 20 bp, Artificial
  20-mer unique DNA sequence
gcggttctggggctgcattg

SEQ ID NO: 1213 - DNA, 20 bp, Artificial
  20-mer unique DNA sequence
gtcgggggtgagagatggcg

SEQ ID NO: 1214 - DNA, 20 bp, Artificial
  20-mer unique DNA sequence
tggggatgcggatgaaagcc

SEQ ID NO: 1215 - DNA, 20 bp, Artificial
  20-mer unique DNA sequence
ggcttggtgaatctggcggc

SEQ ID NO: 1216 - DNA, 20 bp, Artificial
  20-mer unique DNA sequence
agggataaggcgggggtgag

SEQ ID NO: 1217 - DNA, 20 bp, Artificial
  20-mer unique DNA sequence
tcgcccgcctcccactgtac

SEQ ID NO: 1218 - DNA, 20 bp, Artificial
  20-mer unique DNA sequence
agcctccgagatagccaagc

SEQ ID NO: 1219 - DNA, 20 bp, Artificial
  20-mer unique DNA sequence
ggcccgctcccacaaaaata

SEQ ID NO: 1220 - DNA, 20 bp, Artificial
  20-mer unique DNA sequence
acgcatctaacccccgcaag

SEQ ID NO: 1221 - DNA, 20 bp, Artificial
  20-mer unique DNA sequence
gcacggtttttgatgggccc

SEQ ID NO: 1222 - DNA, 20 bp, Artificial
  20-mer unique DNA sequence
gtcccgtcccaattacccca

SEQ ID NO: 1223 - DNA, 20 bp, Artificial
  20-mer unique DNA sequence
gagccaccgcccgacatgac

SEQ ID NO: 1224 - DNA, 20 bp, Artificial
  20-mer unique DNA sequence
tatcttctcgcccctccgcc

SEQ ID NO: 1225 - DNA, 20 bp, Artificial
  20-mer unique DNA sequence
cgagtttatccaaggccccg

SEQ ID NO: 1226 - DNA, 20 bp, Artificial
  20-mer unique DNA sequence
cccaccgccttgcatgtctg

SEQ ID NO: 1227 - DNA, 20 bp, Artificial
  20-mer unique DNA sequence
gtcaaccaatccagcggcgt

SEQ ID NO: 1228 - DNA, 20 bp, Artificial
  20-mer unique DNA sequence
tcgcgtcccacttctgcacg

SEQ ID NO: 1229 - DNA, 20 bp, Artificial
  20-mer unique DNA sequence
tcagcccatagaacgccgcg

SEQ ID NO: 1230 - DNA, 20 bp, Artificial
  20-mer unique DNA sequence
gcgggaaggagacacgggaa

SEQ ID NO: 1231 - DNA, 20 bp, Artificial
  20-mer unique DNA sequence
attggttgactttgcgcccc

SEQ ID NO: 1232 - DNA, 20 bp, Artificial
  20-mer unique DNA sequence
gcctacccgtgcaaccctgt

SEQ ID NO: 1233 - DNA, 20 bp, Artificial
  20-mer unique DNA sequence
cgtcgttgcatagccctccc

SEQ ID NO: 1234 - DNA, 20 bp, Artificial
  20-mer unique DNA sequence
ctccccgctcttcgtcacct

SEQ ID NO: 1235 - DNA, 20 bp, Artificial
  20-mer unique DNA sequence
aacgtgatgtgtgggcctgc

SEQ ID NO: 1236 - DNA, 20 bp, Artificial
  20-mer unique DNA sequence
cccaccggcgttccactcat

SEQ ID NO: 1237 - DNA, 20 bp, Artificial
  20-mer unique DNA sequence
ggccgcgtctttcctctttg

SEQ ID NO: 1238 - DNA, 20 bp, Artificial
  20-mer unique DNA sequence
ccccgcgctcatctattccg

SEQ ID NO: 1239 - DNA, 20 bp, Artificial
  20-mer unique DNA sequence
cgctgtgtcgtgctccctgc

SEQ ID NO: 1240 - DNA, 20 bp, Artificial
  20-mer unique DNA sequence
cccagctttgcacaccgaga

SEQ ID NO: 1241 - DNA, 20 bp, Artificial
  20-mer unique DNA sequence
cctagccacatccccccgag

SEQ ID NO: 1242 - DNA, 20 bp, Artificial
  20-mer unique DNA sequence
gccgtccgtcccatccgtaa

SEQ ID NO: 1243 - DNA, 20 bp, Artificial
  20-mer unique DNA sequence
ctaccgaatcacccgccccc

SEQ ID NO: 1244 - DNA, 20 bp, Artificial
  20-mer unique DNA sequence
tttgatttggcacctcggcg

SEQ ID NO: 1245 - DNA, 20 bp, Artificial
  20-mer unique DNA sequence
acatcggggggtggcctagg

SEQ ID NO: 1246 - DNA, 20 bp, Artificial
  20-mer unique DNA sequence
gaagaaacacccggcgaccc

SEQ ID NO: 1247 - DNA, 20 bp, Artificial
  20-mer unique DNA sequence
tttttgctggcgcttcatgg

SEQ ID NO: 1248 - DNA, 20 bp, Artificial
  20-mer unique DNA sequence
tgaggaggggattgcggaag

SEQ ID NO: 1249 - DNA, 20 bp, Artificial
  20-mer unique DNA sequence
agcgcgccgtgattgtaagc

SEQ ID NO: 1250 - DNA, 20 bp, Artificial
  20-mer unique DNA sequence
tcctccccgaccgcatctga

SEQ ID NO: 1251 - DNA, 20 bp, Artificial
  20-mer unique DNA sequence
gggggcgggatccttctgtg

SEQ ID NO: 1252 - DNA, 20 bp, Artificial
  20-mer unique DNA sequence
tcaagcagttccctccccgc

SEQ ID NO: 1253 - DNA, 20 bp, Artificial
  20-mer unique DNA sequence
acggcgatgaggagcggagt

SEQ ID NO: 1254 - DNA, 20 bp, Artificial
  20-mer unique DNA sequence
agccccccactacccgcctt

SEQ ID NO: 1255 - DNA, 20 bp, Artificial
  20-mer unique DNA sequence
cgccacccgcttatcacaca

SEQ ID NO: 1256 - DNA, 20 bp, Artificial
  20-mer unique DNA sequence
tcggagcgaccgtgactact

SEQ ID NO: 1257 - DNA, 20 bp, Artificial
  20-mer unique DNA sequence
aatctgcgaaatcaggcggg

SEQ ID NO: 1258 - DNA, 20 bp, Artificial
  20-mer unique DNA sequence
tgctaagtgctgtctccggt

SEQ ID NO: 1259 - DNA, 20 bp, Artificial
  20-mer unique DNA sequence
gacccctaaccgccgagcac

SEQ ID NO: 1260 - DNA, 20 bp, Artificial
  20-mer unique DNA sequence
cagcatgcgcgttcccctaa

SEQ ID NO: 1261 - DNA, 20 bp, Artificial
  20-mer unique DNA sequence
gttgcgggcttcgggttcct

SEQ ID NO: 1262 - DNA, 20 bp, Artificial
  20-mer unique DNA sequence
tgtctaccgcgagatctgcg

SEQ ID NO: 1263 - DNA, 20 bp, Artificial
  20-mer unique DNA sequence
cggatgctacgggtttcggt

SEQ ID NO: 1264 - DNA, 20 bp, Artificial
  20-mer unique DNA sequence
gggcagcgggtgaacatcag

SEQ ID NO: 1265 - DNA, 20 bp, Artificial
  20-mer unique DNA sequence
ttcctgtcttgcctccgcca

SEQ ID NO: 1266 - DNA, 20 bp, Artificial
  20-mer unique DNA sequence
ggaaagggggaggacgaccg

SEQ ID NO: 1267 - DNA, 20 bp, Artificial
  20-mer unique DNA sequence
tagccttccccatcgcctcg

SEQ ID NO: 1268 - DNA, 20 bp, Artificial
  20-mer unique DNA sequence
tcgtctccgctccccctgaa

SEQ ID NO: 1269 - DNA, 20 bp, Artificial
  20-mer unique DNA sequence
tgccggttcgcgtactgttc

SEQ ID NO: 1270 - DNA, 20 bp, Artificial
  20-mer unique DNA sequence
tgcaaaatagccgcggaatg

SEQ ID NO: 1271 - DNA, 20 bp, Artificial
  20-mer unique DNA sequence
caaatcgaaaggcccgcaga

SEQ ID NO: 1272 - DNA, 20 bp, Artificial
  20-mer unique DNA sequence
cccggcccttcgcagacata

SEQ ID NO: 1273 - DNA, 20 bp, Artificial
  20-mer unique DNA sequence
aataccgcccttccgacccg

SEQ ID NO: 1274 - DNA, 20 bp, Artificial
  20-mer unique DNA sequence
cactttccctcgcgtttgag

SEQ ID NO: 1275 - DNA, 20 bp, Artificial
  20-mer unique DNA sequence
aaccgcgaccctttcgatcg

SEQ ID NO: 1276 - DNA, 20 bp, Artificial
  20-mer unique DNA sequence
gtgccacggtttttgcggtg

SEQ ID NO: 1277 - DNA, 20 bp, Artificial
  20-mer unique DNA sequence
tctcccggccttgctcattc

SEQ ID NO: 1278 - DNA, 20 bp, Artificial
  20-mer unique DNA sequence
ttcgtgcggctggggtatcg

SEQ ID NO: 1279 - DNA, 20 bp, Artificial
  20-mer unique DNA sequence
aaacaccctgcgaccccgtc

SEQ ID NO: 1280 - DNA, 20 bp, Artificial
  20-mer unique DNA sequence
cggaggattgacgtggtttt

SEQ ID NO: 1281 - DNA, 20 bp, Artificial
  20-mer unique DNA sequence
ctatgccgcccaatctccga

SEQ ID NO: 1282 - DNA, 20 bp, Artificial
  20-mer unique DNA sequence
ccgatacgccttgtccctgc

SEQ ID NO: 1283 - DNA, 20 bp, Artificial
  20-mer unique DNA sequence
ccttccgccgccttgcttag

SEQ ID NO: 1284 - DNA, 20 bp, Artificial
  20-mer unique DNA sequence
cgtcgtaccctcaaaccgcc

SEQ ID NO: 1285 - DNA, 20 bp, Artificial
  20-mer unique DNA sequence
ttcggatcgggaggttggga

SEQ ID NO: 1286 - DNA, 20 bp, Artificial
  20-mer unique DNA sequence
caggagggtggatggctacg

SEQ ID NO: 1287 - DNA, 20 bp, Artificial
  20-mer unique DNA sequence
tgctactcccctcgcccctc

SEQ ID NO: 1288 - DNA, 20 bp, Artificial
  20-mer unique DNA sequence
cgtctatatccaggccggcg

SEQ ID NO: 1289 - DNA, 20 bp, Artificial
  20-mer unique DNA sequence
tgtctctcgctgcccaatcg

SEQ ID NO: 1290 - DNA, 20 bp, Artificial
  20-mer unique DNA sequence
agccccttattttgcccccg

SEQ ID NO: 1291 - DNA, 20 bp, Artificial
  20-mer unique DNA sequence
aggtaaaaacggcgggggac

SEQ ID NO: 1292 - DNA, 20 bp, Artificial
  20-mer unique DNA sequence
atgcatatgtccgccgccac

SEQ ID NO: 1293 - DNA, 20 bp, Artificial
  20-mer unique DNA sequence
gcctggttgcggttggtaca

SEQ ID NO: 1294 - DNA, 20 bp, Artificial
  20-mer unique DNA sequence
tacaccccgcatccaacctc

SEQ ID NO: 1295 - DNA, 20 bp, Artificial
  20-mer unique DNA sequence
aatcaggggggcgaaggtgt

SEQ ID NO: 1296 - DNA, 20 bp, Artificial
  20-mer unique DNA sequence
cataaccggctgctccccta

SEQ ID NO: 1297 - DNA, 20 bp, Artificial
  20-mer unique DNA sequence
gcgagcagatttgggcacac

SEQ ID NO: 1298 - DNA, 20 bp, Artificial
  20-mer unique DNA sequence
cctaattggatgcgggggct

SEQ ID NO: 1299 - DNA, 20 bp, Artificial
  20-mer unique DNA sequence
tgcatcccctttaatgtcgc

SEQ ID NO: 1300 - DNA, 20 bp, Artificial
  20-mer unique DNA sequence
gtcatcttggttccgcgccg

SEQ ID NO: 1301 - DNA, 20 bp, Artificial
  20-mer unique DNA sequence
gacgggggtgcgacaaatgg

SEQ ID NO: 1302 - DNA, 20 bp, Artificial
  20-mer unique DNA sequence
ccccgaaaaggatgctgcgt

SEQ ID NO: 1303 - DNA, 20 bp, Artificial
  20-mer unique DNA sequence
tccgggctcaccaaactgtg

SEQ ID NO: 1304 - DNA, 20 bp, Artificial
  20-mer unique DNA sequence
tggcgcgtcaggtagcatgg

SEQ ID NO: 1305 - DNA, 20 bp, Artificial
  20-mer unique DNA sequence
agagaaaccacgcccccacc

SEQ ID NO: 1306 - DNA, 20 bp, Artificial
  20-mer unique DNA sequence
tgaggtcgcaagggagacgg

SEQ ID NO: 1307 - DNA, 20 bp, Artificial
  20-mer unique DNA sequence
cagccccaatccaacgaaca

SEQ ID NO: 1308 - DNA, 20 bp, Artificial
  20-mer unique DNA sequence
ggggttaacgggagagggga

SEQ ID NO: 1309 - DNA, 20 bp, Artificial
  20-mer unique DNA sequence
ggcgcgaggaatggtggtta

SEQ ID NO: 1310 - DNA, 20 bp, Artificial
  20-mer unique DNA sequence
cggagattcgcaacgggctg

SEQ ID NO: 1311 - DNA, 20 bp, Artificial
  20-mer unique DNA sequence
acgccccgccgcagactaac

SEQ ID NO: 1312 - DNA, 20 bp, Artificial
  20-mer unique DNA sequence
ccggggagggagagacagct

SEQ ID NO: 1313 - DNA, 20 bp, Artificial
  20-mer unique DNA sequence
ccgattgggtttggcacagc

SEQ ID NO: 1314 - DNA, 20 bp, Artificial
  20-mer unique DNA sequence
agtatagggtgcgcgggcca

SEQ ID NO: 1315 - DNA, 20 bp, Artificial
  20-mer unique DNA sequence
ccctcagaaagccctcgcga

SEQ ID NO: 1316 - DNA, 20 bp, Artificial
  20-mer unique DNA sequence
gttgcgagggagtggtggga

SEQ ID NO: 1317 - DNA, 20 bp, Artificial
  20-mer unique DNA sequence
cctggagaacgcgcaacacg

SEQ ID NO: 1318 - DNA, 20 bp, Artificial
  20-mer unique DNA sequence
gctcccgtggtgtgacatct

SEQ ID NO: 1319 - DNA, 20 bp, Artificial
  20-mer unique DNA sequence
cagcctgggaccgtttcaca

SEQ ID NO: 1320 - DNA, 20 bp, Artificial
  20-mer unique DNA sequence
aggactcaaaagaacggggg

SEQ ID NO: 1321 - DNA, 20 bp, Artificial
  20-mer unique DNA sequence
ttacggatggggcggagatg

SEQ ID NO: 1322 - DNA, 20 bp, Artificial
  20-mer unique DNA sequence
cttctctgtcctgcgggggg

SEQ ID NO: 1323 - DNA, 20 bp, Artificial
  20-mer unique DNA sequence
agcgggagcaggtctatggt

SEQ ID NO: 1324 - DNA, 20 bp, Artificial
  20-mer unique DNA sequence
aacccaccgcacgtcaaaca

SEQ ID NO: 1325 - DNA, 20 bp, Artificial
  20-mer unique DNA sequence
gccctgccacaacctccctt

SEQ ID NO: 1326 - DNA, 20 bp, Artificial
  20-mer unique DNA sequence
cacggcgtgcgctagtctaa

SEQ ID NO: 1327 - DNA, 20 bp, Artificial
  20-mer unique DNA sequence
acgggtccctggggtctaaa

SEQ ID NO: 1328 - DNA, 20 bp, Artificial
  20-mer unique DNA sequence
aaaaaggggatcgcggcaaa

SEQ ID NO: 1329 - DNA, 20 bp, Artificial
  20-mer unique DNA sequence
cggggatgcgtgccaaacat

SEQ ID NO: 1330 - DNA, 20 bp, Artificial
  20-mer unique DNA sequence
tttcggtggcaggtcgttga

SEQ ID NO: 1331 - DNA, 20 bp, Artificial
  20-mer unique DNA sequence
tctcatttgccgctcctgcg

SEQ ID NO: 1332 - DNA, 20 bp, Artificial
  20-mer unique DNA sequence
gggcgtctctggggggtcaa

SEQ ID NO: 1333 - DNA, 20 bp, Artificial
  20-mer unique DNA sequence
ctggattgcgtgggcctttc

SEQ ID NO: 1334 - DNA, 20 bp, Artificial
  20-mer unique DNA sequence
acgcctccggtttccacaat

SEQ ID NO: 1335 - DNA, 20 bp, Artificial
  20-mer unique DNA sequence
cctcctagccatgcccccga

SEQ ID NO: 1336 - DNA, 20 bp, Artificial
  20-mer unique DNA sequence
acttggggtgtcggccgctt

SEQ ID NO: 1337 - DNA, 20 bp, Artificial
  20-mer unique DNA sequence
gctggcactgacgggctgat

SEQ ID NO: 1338 - DNA, 20 bp, Artificial
  20-mer unique DNA sequence
acacgcgcctgtcgcctaaa

SEQ ID NO: 1339 - DNA, 20 bp, Artificial
  20-mer unique DNA sequence
gggaactaaccaccgcgagc

SEQ ID NO: 1340 - DNA, 20 bp, Artificial
  20-mer unique DNA sequence
cggtggcgcctggattatgg

SEQ ID NO: 1341 - DNA, 20 bp, Artificial
  20-mer unique DNA sequence
acaaacgcgatcggaaccct

SEQ ID NO: 1342 - DNA, 20 bp, Artificial
  20-mer unique DNA sequence
tggtcatcgttctcgctcgg

SEQ ID NO: 1343 - DNA, 20 bp, Artificial
  20-mer unique DNA sequence
acaacgccccttacccctgg

SEQ ID NO: 1344 - DNA, 20 bp, Artificial
  20-mer unique DNA sequence
ccttatcaccgcccgacgaa

SEQ ID NO: 1345 - DNA, 20 bp, Artificial
  20-mer unique DNA sequence
ccgcgcaccaataaggcaac

SEQ ID NO: 1346 - DNA, 20 bp, Artificial
  20-mer unique DNA sequence
gcgactgactatccaggcga

SEQ ID NO: 1347 - DNA, 20 bp, Artificial
  20-mer unique DNA sequence
acgaatggtgccctagtcgc

SEQ ID NO: 1348 - DNA, 20 bp, Artificial
  20-mer unique DNA sequence
cggagcgctcgtatgtgcca

SEQ ID NO: 1349 - DNA, 20 bp, Artificial
  20-mer unique DNA sequence
acgtagaccgtgggggcctt

SEQ ID NO: 1350 - DNA, 20 bp, Artificial
  20-mer unique DNA sequence
tcgctaaagcttggggggcc

SEQ ID NO: 1351 - DNA, 20 bp, Artificial
  20-mer unique DNA sequence
cgacacattccgcggctcac

SEQ ID NO: 1352 - DNA, 20 bp, Artificial
  20-mer unique DNA sequence
caagaccgtatcagcgccga

SEQ ID NO: 1353 - DNA, 20 bp, Artificial
  20-mer unique DNA sequence
actcaaatgccctcgccgtg

SEQ ID NO: 1354 - DNA, 20 bp, Artificial
  20-mer unique DNA sequence
cccggcccttgatgctatgt

SEQ ID NO: 1355 - DNA, 20 bp, Artificial
  20-mer unique DNA sequence
tcgttcgcccagcctatgcc

SEQ ID NO: 1356 - DNA, 20 bp, Artificial
  20-mer unique DNA sequence
taatacgaagcgccggcagg

SEQ ID NO: 1357 - DNA, 20 bp, Artificial
  20-mer unique DNA sequence
agccgtcaccacaaatcccg

SEQ ID NO: 1358 - DNA, 20 bp, Artificial
  20-mer unique DNA sequence
cccgcgatggttaggcaagt

SEQ ID NO: 1359 - DNA, 20 bp, Artificial
  20-mer unique DNA sequence
cctctccgcatccccctctc

SEQ ID NO: 1360 - DNA, 20 bp, Artificial
  20-mer unique DNA sequence
atgactgatttgggccccct

SEQ ID NO: 1361 - DNA, 20 bp, Artificial
  20-mer unique DNA sequence
atcccaaacgcctagacgcg

SEQ ID NO: 1362 - DNA, 20 bp, Artificial
  20-mer unique DNA sequence
tccacctccgcaccctttcc

SEQ ID NO: 1363 - DNA, 20 bp, Artificial
  20-mer unique DNA sequence
tagcagacggatggggaccg

SEQ ID NO: 1364 - DNA, 20 bp, Artificial
  20-mer unique DNA sequence
caatcgaaagggggacgcgt

SEQ ID NO: 1365 - DNA, 20 bp, Artificial
  20-mer unique DNA sequence
gagggccgtgtggatcgtca

SEQ ID NO: 1366 - DNA, 20 bp, Artificial
  20-mer unique DNA sequence
ttcatgtgccctcgtcgctt

SEQ ID NO: 1367 - DNA, 20 bp, Artificial
  20-mer unique DNA sequence
gtgtggaggcgcggatctgc

SEQ ID NO: 1368 - DNA, 20 bp, Artificial
  20-mer unique DNA sequence
gatggatggggtgggggttg

SEQ ID NO: 1369 - DNA, 20 bp, Artificial
  20-mer unique DNA sequence
tttctcgcatccgccaaggg

SEQ ID NO: 1370 - DNA, 20 bp, Artificial
  20-mer unique DNA sequence
gcacggcttttgggcatcat

SEQ ID NO: 1371 - DNA, 20 bp, Artificial
  20-mer unique DNA sequence
cggggctgaaagagggtaac

SEQ ID NO: 1372 - DNA, 20 bp, Artificial
  20-mer unique DNA sequence
cctcctccggtcatgccaaa

SEQ ID NO: 1373 - DNA, 20 bp, Artificial
  20-mer unique DNA sequence
gtggcccgtgttcgcttggt

SEQ ID NO: 1374 - DNA, 20 bp, Artificial
  20-mer unique DNA sequence
agtgacgtaggtggccgggt

SEQ ID NO: 1375 - DNA, 20 bp, Artificial
  20-mer unique DNA sequence
cagcgcttatgaccgggtac

SEQ ID NO: 1376 - DNA, 20 bp, Artificial
  20-mer unique DNA sequence
tacgtcccaaacccacccgg

SEQ ID NO: 1377 - DNA, 20 bp, Artificial
  20-mer unique DNA sequence
gtcctgtcgcaatcgcctct

SEQ ID NO: 1378 - DNA, 20 bp, Artificial
  20-mer unique DNA sequence
cgtccgcaaagaatccccaa

SEQ ID NO: 1379 - DNA, 20 bp, Artificial
  20-mer unique DNA sequence
atcaatcgacgggccctcac

SEQ ID NO: 1380 - DNA, 20 bp, Artificial
  20-mer unique DNA sequence
ttcccttagcgccaaccccg

SEQ ID NO: 1381 - DNA, 20 bp, Artificial
  20-mer unique DNA sequence
aacgagacaaatggggcggt

SEQ ID NO: 1382 - DNA, 20 bp, Artificial
  20-mer unique DNA sequence
ggaggtaatttggggcgcga

SEQ ID NO: 1383 - DNA, 20 bp, Artificial
  20-mer unique DNA sequence
atccggtggtgcgcagttct

SEQ ID NO: 1384 - DNA, 20 bp, Artificial
  20-mer unique DNA sequence
tcggtttttgggcgtgaggt

SEQ ID NO: 1385 - DNA, 20 bp, Artificial
  20-mer unique DNA sequence
ttcccagtcacaggctgtgt

SEQ ID NO: 1386 - DNA, 20 bp, Artificial
  20-mer unique DNA sequence
gcgtccatcggtttcccctc

SEQ ID NO: 1387 - DNA, 20 bp, Artificial
  20-mer unique DNA sequence
gaacatccgcaccccactcc

SEQ ID NO: 1388 - DNA, 20 bp, Artificial
  20-mer unique DNA sequence
gatccttgcggctccttcgg

SEQ ID NO: 1389 - DNA, 20 bp, Artificial
  20-mer unique DNA sequence
cggggtaggttggtgatgcg

SEQ ID NO: 1390 - DNA, 20 bp, Artificial
  20-mer unique DNA sequence
acatcgttcccccagcccat

SEQ ID NO: 1391 - DNA, 20 bp, Artificial
  20-mer unique DNA sequence
tgcgctgaactggctgggta

SEQ ID NO: 1392 - DNA, 20 bp, Artificial
  20-mer unique DNA sequence
cattagtcccggcgccttcc

SEQ ID NO: 1393 - DNA, 20 bp, Artificial
  20-mer unique DNA sequence
atttgccttcctccaccccg

SEQ ID NO: 1394 - DNA, 20 bp, Artificial
  20-mer unique DNA sequence
agggcacgcacaggaagatg

SEQ ID NO: 1395 - DNA, 20 bp, Artificial
  20-mer unique DNA sequence
aacccaacgcgcccctagag

SEQ ID NO: 1396 - DNA, 20 bp, Artificial
  20-mer unique DNA sequence
ctggtggaaattggggggcc

SEQ ID NO: 1397 - DNA, 20 bp, Artificial
  20-mer unique DNA sequence
cgagcgaaacggcgacaaac

SEQ ID NO: 1398 - DNA, 20 bp, Artificial
  20-mer unique DNA sequence
aattgagcgcccccgttgtg

SEQ ID NO: 1399 - DNA, 20 bp, Artificial
  20-mer unique DNA sequence
tgatccggcaacagaacgca

SEQ ID NO: 1400 - DNA, 20 bp, Artificial
  20-mer unique DNA sequence
gaaaacaccgccctgccgat

SEQ ID NO: 1401 - DNA, 20 bp, Artificial
  20-mer unique DNA sequence
caaacatacccgcgcgccac

SEQ ID NO: 1402 - DNA, 20 bp, Artificial
  20-mer unique DNA sequence
gcctcccgtccacacaccga

SEQ ID NO: 1403 - DNA, 20 bp, Artificial
  20-mer unique DNA sequence
ggggtggggatcatggttca

SEQ ID NO: 1404 - DNA, 20 bp, Artificial
  20-mer unique DNA sequence
actcccctgctgcccgcctg

SEQ ID NO: 1405 - DNA, 20 bp, Artificial
  20-mer unique DNA sequence
aggggggttatggggtgcga

SEQ ID NO: 1406 - DNA, 20 bp, Artificial
  20-mer unique DNA sequence
aacttcgccctatcgcccgc

SEQ ID NO: 1407 - DNA, 20 bp, Artificial
  20-mer unique DNA sequence
gcacgagggatgaagcgacc

SEQ ID NO: 1408 - DNA, 20 bp, Artificial
  20-mer unique DNA sequence
tcgggggtgtgcggttatcc

SEQ ID NO: 1409 - DNA, 20 bp, Artificial
  20-mer unique DNA sequence
cctctgggcttgtgcactgg

SEQ ID NO: 1410 - DNA, 20 bp, Artificial
  20-mer unique DNA sequence
tcagagagggctagcgggcg

SEQ ID NO: 1411 - DNA, 20 bp, Artificial
  20-mer unique DNA sequence
gttccccggcttgcatgtcg

SEQ ID NO: 1412 - DNA, 20 bp, Artificial
  20-mer unique DNA sequence
tctcccattgcaccgaccac

SEQ ID NO: 1413 - DNA, 20 bp, Artificial
  20-mer unique DNA sequence
cgcgacaaacacgagccaag

SEQ ID NO: 1414 - DNA, 20 bp, Artificial
  20-mer unique DNA sequence
tggcccgcaaaactcctgtc

SEQ ID NO: 1415 - DNA, 20 bp, Artificial
  20-mer unique DNA sequence
attgaggattggcgggtggc

SEQ ID NO: 1416 - DNA, 20 bp, Artificial
  20-mer unique DNA sequence
cccgtttcccactcccgtca

SEQ ID NO: 1417 - DNA, 20 bp, Artificial
  20-mer unique DNA sequence
cacccagcaccattccgcag

SEQ ID NO: 1418 - DNA, 20 bp, Artificial
  20-mer unique DNA sequence
gtgttgtcgggcggttccag

SEQ ID NO: 1419 - DNA, 20 bp, Artificial
  20-mer unique DNA sequence
ggatcctgcgcccctggata

SEQ ID NO: 1420 - DNA, 20 bp, Artificial
  20-mer unique DNA sequence
acataccgcggcagtctgaa

SEQ ID NO: 1421 - DNA, 20 bp, Artificial
  20-mer unique DNA sequence
gtccgagaatcggccagcta

SEQ ID NO: 1422 - DNA, 20 bp, Artificial
  20-mer unique DNA sequence
cccggttgctccatcgactg

SEQ ID NO: 1423 - DNA, 20 bp, Artificial
  20-mer unique DNA sequence
gccggtttggcccttccagt

SEQ ID NO: 1424 - DNA, 20 bp, Artificial
  20-mer unique DNA sequence
agactgggtgagcgcaacgg

SEQ ID NO: 1425 - DNA, 20 bp, Artificial
  20-mer unique DNA sequence
aagccccccctgtatgtccg

SEQ ID NO: 1426 - DNA, 20 bp, Artificial
  20-mer unique DNA sequence
ttcggttccaggcggttcgt

SEQ ID NO: 1427 - DNA, 20 bp, Artificial
  20-mer unique DNA sequence
cacgaggaacgccagccaca

SEQ ID NO: 1428 - DNA, 20 bp, Artificial
  20-mer unique DNA sequence
acctgtgatcagtgcgccac

SEQ ID NO: 1429 - DNA, 20 bp, Artificial
  20-mer unique DNA sequence
cgctgcggcatagttaaccc

SEQ ID NO: 1430 - DNA, 20 bp, Artificial
  20-mer unique DNA sequence
gcacagctgataggccccgt

SEQ ID NO: 1431 - DNA, 20 bp, Artificial
  20-mer unique DNA sequence
cccagcatactgcaacggca

SEQ ID NO: 1432 - DNA, 20 bp, Artificial
  20-mer unique DNA sequence
ggcacgtacgtcatgcacac

SEQ ID NO: 1433 - DNA, 20 bp, Artificial
  20-mer unique DNA sequence
actgtcggaagtccacgctt

SEQ ID NO: 1434 - DNA, 20 bp, Artificial
  20-mer unique DNA sequence
cgttgtggagcggtatgcgg

SEQ ID NO: 1435 - DNA, 20 bp, Artificial
  20-mer unique DNA sequence
cgtaggggggagtgggcgat

SEQ ID NO: 1436 - DNA, 20 bp, Artificial
  20-mer unique DNA sequence
gcgatggattggcgagggct

SEQ ID NO: 1437 - DNA, 20 bp, Artificial
  20-mer unique DNA sequence
tccaacatatcccgcagccg

SEQ ID NO: 1438 - DNA, 20 bp, Artificial
  20-mer unique DNA sequence
gcgaaccgagggaaggcatc

SEQ ID NO: 1439 - DNA, 20 bp, Artificial
  20-mer unique DNA sequence
ccaaatcctcaaagcgggcc

SEQ ID NO: 1440 - DNA, 20 bp, Artificial
  20-mer unique DNA sequence
ccgcgctgccacactcatac

SEQ ID NO: 1441 - DNA, 20 bp, Artificial
  20-mer unique DNA sequence
acgcggggggaggaaacatg

SEQ ID NO: 1442 - DNA, 20 bp, Artificial
  20-mer unique DNA sequence
ccattgtgggcccgcttcag

SEQ ID NO: 1443 - DNA, 20 bp, Artificial
  20-mer unique DNA sequence
gaaggatcaggacggggggg

SEQ ID NO: 1444 - DNA, 20 bp, Artificial
  20-mer unique DNA sequence
tgactcgggggtgctgctta

SEQ ID NO: 1445 - DNA, 20 bp, Artificial
  20-mer unique DNA sequence
ccagagcaaaacgacaggcg

SEQ ID NO: 1446 - DNA, 20 bp, Artificial
  20-mer unique DNA sequence
cgtaaagggccggcaatagg

SEQ ID NO: 1447 - DNA, 20 bp, Artificial
  20-mer unique DNA sequence
tcaactcctccaagccacgc

SEQ ID NO: 1448 - DNA, 20 bp, Artificial
  20-mer unique DNA sequence
agccgatgcacttttccccc

SEQ ID NO: 1449 - DNA, 20 bp, Artificial
  20-mer unique DNA sequence
gtcgacatcccacgcccaac

SEQ ID NO: 1450 - DNA, 20 bp, Artificial
  20-mer unique DNA sequence
actgtagaccaaccgtggcg

SEQ ID NO: 1451 - DNA, 20 bp, Artificial
  20-mer unique DNA sequence
ggctcagatcggtgccatgt

SEQ ID NO: 1452 - DNA, 20 bp, Artificial
  20-mer unique DNA sequence
aagagatccccgcccgacac

SEQ ID NO: 1453 - DNA, 20 bp, Artificial
  20-mer unique DNA sequence
cccaccatgccgtcgactta

SEQ ID NO: 1454 - DNA, 20 bp, Artificial
  20-mer unique DNA sequence
ggggcgcaggactcattcat

SEQ ID NO: 1455 - DNA, 20 bp, Artificial
  20-mer unique DNA sequence
ccggtctaatcgccccctgt

SEQ ID NO: 1456 - DNA, 20 bp, Artificial
  20-mer unique DNA sequence
gggccatgagacgcggagag

SEQ ID NO: 1457 - DNA, 20 bp, Artificial
  20-mer unique DNA sequence
ggggggctttagaggaggcg

SEQ ID NO: 1458 - DNA, 20 bp, Artificial
  20-mer unique DNA sequence
tggggttctagacggcatgc

SEQ ID NO: 1459 - DNA, 20 bp, Artificial
  20-mer unique DNA sequence
cgacgccggacctgaatttg

SEQ ID NO: 1460 - DNA, 20 bp, Artificial
  20-mer unique DNA sequence
ttgggcggagacgaatgaca

SEQ ID NO: 1461 - DNA, 20 bp, Artificial
  20-mer unique DNA sequence
aaagacgccccaccaccaac

SEQ ID NO: 1462 - DNA, 20 bp, Artificial
  20-mer unique DNA sequence
accgggaggtgatgggaaaa

SEQ ID NO: 1463 - DNA, 20 bp, Artificial
  20-mer unique DNA sequence
gcgtaagcggggaaggtgag

SEQ ID NO: 1464 - DNA, 20 bp, Artificial
  20-mer unique DNA sequence
cgacccgcttctcgtgttcc

SEQ ID NO: 1465 - DNA, 20 bp, Artificial
  20-mer unique DNA sequence
aaaccgccaacgaactccca

SEQ ID NO: 1466 - DNA, 20 bp, Artificial
  20-mer unique DNA sequence
aggtgctgtgcggggactgt

SEQ ID NO: 1467 - DNA, 20 bp, Artificial
  20-mer unique DNA sequence
agccaacggaacgcacaggt

SEQ ID NO: 1468 - DNA, 20 bp, Artificial
  20-mer unique DNA sequence
tggggcaacttacgggtggc

SEQ ID NO: 1469 - DNA, 20 bp, Artificial
  20-mer unique DNA sequence
cagacgaaccgaggacagcg

SEQ ID NO: 1470 - DNA, 20 bp, Artificial
  20-mer unique DNA sequence
cccaggaaacagacccgccc

SEQ ID NO: 1471 - DNA, 20 bp, Artificial
  20-mer unique DNA sequence
gtctcaatccctcgggccaa

SEQ ID NO: 1472 - DNA, 20 bp, Artificial
  20-mer unique DNA sequence
cccgccctgataaaccgctc

SEQ ID NO: 1473 - DNA, 20 bp, Artificial
  20-mer unique DNA sequence
gcagtgggtgactttggcga

SEQ ID NO: 1474 - DNA, 20 bp, Artificial
  20-mer unique DNA sequence
cacgcgcggatacctcgaaa

SEQ ID NO: 1475 - DNA, 20 bp, Artificial
  20-mer unique DNA sequence
cacccccttccaggacgcta

SEQ ID NO: 1476 - DNA, 20 bp, Artificial
  20-mer unique DNA sequence
cgtgaaaaaagcgcgaaggc

SEQ ID NO: 1477 - DNA, 20 bp, Artificial
  20-mer unique DNA sequence
ggattagtgtcgggaggcgc

SEQ ID NO: 1478 - DNA, 20 bp, Artificial
  20-mer unique DNA sequence
ctcaccccccaggaaaaggc

SEQ ID NO: 1479 - DNA, 20 bp, Artificial
  20-mer unique DNA sequence
ttcagtcccctaccgccctg

SEQ ID NO: 1480 - DNA, 20 bp, Artificial
  20-mer unique DNA sequence
tcggggtcgctgctttaggt

SEQ ID NO: 1481 - DNA, 20 bp, Artificial
  20-mer unique DNA sequence
tgaatttcgcgtgggctgtc

SEQ ID NO: 1482 - DNA, 20 bp, Artificial
  20-mer unique DNA sequence
cacccttcatgcccccagtc

SEQ ID NO: 1483 - DNA, 20 bp, Artificial
  20-mer unique DNA sequence
ccggttcccagccttctcgc

SEQ ID NO: 1484 - DNA, 20 bp, Artificial
  20-mer unique DNA sequence
tcaacgccacccgccaactc

SEQ ID NO: 1485 - DNA, 20 bp, Artificial
  20-mer unique DNA sequence
tgccaacctcttcccctccg

SEQ ID NO: 1486 - DNA, 20 bp, Artificial
  20-mer unique DNA sequence
gcaatgatacgccgccccca

SEQ ID NO: 1487 - DNA, 20 bp, Artificial
  20-mer unique DNA sequence
tcgccaatcccccagctttt

SEQ ID NO: 1488 - DNA, 20 bp, Artificial
  20-mer unique DNA sequence
acgctccccgacacaacctc

SEQ ID NO: 1489 - DNA, 20 bp, Artificial
  20-mer unique DNA sequence
tgattgcgttcggcggtttg

SEQ ID NO: 1490 - DNA, 20 bp, Artificial
  20-mer unique DNA sequence
ggaggcaaagccgagaatgg

SEQ ID NO: 1491 - DNA, 20 bp, Artificial
  20-mer unique DNA sequence
tttacggggcgttttcgctg

SEQ ID NO: 1492 - DNA, 20 bp, Artificial
  20-mer unique DNA sequence
atccgcgctatgcacccttg

SEQ ID NO: 1493 - DNA, 20 bp, Artificial
  20-mer unique DNA sequence
cgcggatgggagtgttctga

SEQ ID NO: 1494 - DNA, 20 bp, Artificial
  20-mer unique DNA sequence
ccgcgacatgacgcacttag

SEQ ID NO: 1495 - DNA, 20 bp, Artificial
  20-mer unique DNA sequence
aactgtcctcacaggcccac

SEQ ID NO: 1496 - DNA, 20 bp, Artificial
  20-mer unique DNA sequence
tgggttaacggggagcgcaa

SEQ ID NO: 1497 - DNA, 20 bp, Artificial
  20-mer unique DNA sequence
ccagaaatccgcgccacagg

SEQ ID NO: 1498 - DNA, 20 bp, Artificial
  20-mer unique DNA sequence
cttatcgccgctttggctgc

SEQ ID NO: 1499 - DNA, 20 bp, Artificial
  20-mer unique DNA sequence
agcttgccggacccattcgg

SEQ ID NO: 1500 - DNA, 20 bp, Artificial
  20-mer unique DNA sequence
gcaggtcgcggggaaacaac

SEQ ID NO: 1501 - DNA, 20 bp, Artificial
  20-mer unique DNA sequence
gttgcgcgacgggagttcat

SEQ ID NO: 1502 - DNA, 20 bp, Artificial
  20-mer unique DNA sequence
tgcgttgctggaatggagtg

SEQ ID NO: 1503 - DNA, 20 bp, Artificial
  20-mer unique DNA sequence
acctccccaggtgcgacctc

SEQ ID NO: 1504 - DNA, 20 bp, Artificial
  20-mer unique DNA sequence
ttgcccgccttcccaagtct

SEQ ID NO: 1505 - DNA, 20 bp, Artificial
  20-mer unique DNA sequence
ggtaaggcgaatgggcaaca

SEQ ID NO: 1506 - DNA, 20 bp, Artificial
  20-mer unique DNA sequence
atccgcgtctttcccccttc

SEQ ID NO: 1507 - DNA, 20 bp, Artificial
  20-mer unique DNA sequence
ccgcgggccacttgttcttt

SEQ ID NO: 1508 - DNA, 20 bp, Artificial
  20-mer unique DNA sequence
accaccctgggaccctgtta

SEQ ID NO: 1509 - DNA, 20 bp, Artificial
  20-mer unique DNA sequence
ggtacggcagccgctttaga

SEQ ID NO: 1510 - DNA, 20 bp, Artificial
  20-mer unique DNA sequence
gggttcgacagggagggggt

SEQ ID NO: 1511 - DNA, 20 bp, Artificial
  20-mer unique DNA sequence
agcccgacgcgatttgtatt

SEQ ID NO: 1512 - DNA, 20 bp, Artificial
  20-mer unique DNA sequence
tcgacgcgggagagggaaca

SEQ ID NO: 1513 - DNA, 20 bp, Artificial
  20-mer unique DNA sequence
gctcttgcgtcccccgttag

SEQ ID NO: 1514 - DNA, 20 bp, Artificial
  20-mer unique DNA sequence
gctgccccgatgattccaac

SEQ ID NO: 1515 - DNA, 20 bp, Artificial
  20-mer unique DNA sequence
ggggccggcgtagtttttgg

SEQ ID NO: 1516 - DNA, 20 bp, Artificial
  20-mer unique DNA sequence
agtgggacgggcttgcatca

SEQ ID NO: 1517 - DNA, 20 bp, Artificial
  20-mer unique DNA sequence
ctaacgtatccctcggcgcc

SEQ ID NO: 1518 - DNA, 20 bp, Artificial
  20-mer unique DNA sequence
tcacccaccgtcgcctgtct

SEQ ID NO: 1519 - DNA, 20 bp, Artificial
  20-mer unique DNA sequence
tcatcacgcaccccgagttc

SEQ ID NO: 1520 - DNA, 20 bp, Artificial
  20-mer unique DNA sequence
gcggaccctcgatagcagca

SEQ ID NO: 1521 - DNA, 20 bp, Artificial
  20-mer unique DNA sequence
ttcgcagggtccattctccc

SEQ ID NO: 1522 - DNA, 20 bp, Artificial
  20-mer unique DNA sequence
aaacgcccttcgcccacctg

SEQ ID NO: 1523 - DNA, 20 bp, Artificial
  20-mer unique DNA sequence
ctcgtgcagattttgggggg

SEQ ID NO: 1524 - DNA, 20 bp, Artificial
  20-mer unique DNA sequence
gggcccgtgatcgcttatgg

SEQ ID NO: 1525 - DNA, 20 bp, Artificial
  20-mer unique DNA sequence
cgtgtttaggccccgtgcga

SEQ ID NO: 1526 - DNA, 20 bp, Artificial
  20-mer unique DNA sequence
gcagcgctacactcccgacc

SEQ ID NO: 1527 - DNA, 20 bp, Artificial
  20-mer unique DNA sequence
gcgacggccatcaacacaat

SEQ ID NO: 1528 - DNA, 20 bp, Artificial
  20-mer unique DNA sequence
ttgcgcgctttgaattttgg

SEQ ID NO: 1529 - DNA, 20 bp, Artificial
  20-mer unique DNA sequence
ttacgggcggcagggagcta

SEQ ID NO: 1530 - DNA, 20 bp, Artificial
  20-mer unique DNA sequence
gtcgctcgtggggttgtgct

SEQ ID NO: 1531 - DNA, 20 bp, Artificial
  20-mer unique DNA sequence
caggatgcaacgaaacggaa

SEQ ID NO: 1532 - DNA, 20 bp, Artificial
  20-mer unique DNA sequence
ataatgagggccgcgcgtga

SEQ ID NO: 1533 - DNA, 20 bp, Artificial
  20-mer unique DNA sequence
ggaagtggtgtgcgtggggg

SEQ ID NO: 1534 - DNA, 20 bp, Artificial
  20-mer unique DNA sequence
tcaggacttgcgcggggata

SEQ ID NO: 1535 - DNA, 20 bp, Artificial
  20-mer unique DNA sequence
gacccatcaaacacgccccg

SEQ ID NO: 1536 - DNA, 20 bp, Artificial
  20-mer unique DNA sequence
gcccattctcacccgtcctg

SEQ ID NO: 1537 - DNA, 20 bp, Artificial
  20-mer unique DNA sequence
actagggtcaaatcgggggc

SEQ ID NO: 1538 - DNA, 20 bp, Artificial
  20-mer unique DNA sequence
acggggggggaaaacgattg

SEQ ID NO: 1539 - DNA, 20 bp, Artificial
  20-mer unique DNA sequence
gttttggcgggctgtggtgc

SEQ ID NO: 1540 - DNA, 20 bp, Artificial
  20-mer unique DNA sequence
aaatggcccgcaaggacgaa

SEQ ID NO: 1541 - DNA, 20 bp, Artificial
  20-mer unique DNA sequence
aaacctgacccgaagcccgc

SEQ ID NO: 1542 - DNA, 20 bp, Artificial
  20-mer unique DNA sequence
tgggccaccgatcttaagcg

SEQ ID NO: 1543 - DNA, 20 bp, Artificial
  20-mer unique DNA sequence
gtgttgggcgggaggtgtcc

SEQ ID NO: 1544 - DNA, 20 bp, Artificial
  20-mer unique DNA sequence
aaactggtagtggcgggcgg

SEQ ID NO: 1545 - DNA, 20 bp, Artificial
  20-mer unique DNA sequence
caggtcccccgtcgtcatct

SEQ ID NO: 1546 - DNA, 20 bp, Artificial
  20-mer unique DNA sequence
aaggctgcgtgggaattcgg

SEQ ID NO: 1547 - DNA, 20 bp, Artificial
  20-mer unique DNA sequence
gcggatgaggggatggttgg

SEQ ID NO: 1548 - DNA, 20 bp, Artificial
  20-mer unique DNA sequence
ggggcagattcgggtttggg

SEQ ID NO: 1549 - DNA, 20 bp, Artificial
  20-mer unique DNA sequence
tgtgggtggccgtgtaggag

SEQ ID NO: 1550 - DNA, 20 bp, Artificial
  20-mer unique DNA sequence
gagactctaaccgctcggca

SEQ ID NO: 1551 - DNA, 20 bp, Artificial
  20-mer unique DNA sequence
ttcgggagacggagtgcagc

SEQ ID NO: 1552 - DNA, 20 bp, Artificial
  20-mer unique DNA sequence
tcgtgtgtccgcgcgttact

SEQ ID NO: 1553 - DNA, 20 bp, Artificial
  20-mer unique DNA sequence
cgcaatatacaacggccccc

SEQ ID NO: 1554 - DNA, 20 bp, Artificial
  20-mer unique DNA sequence
cgctacgaccgcctccaacc

SEQ ID NO: 1555 - DNA, 20 bp, Artificial
  20-mer unique DNA sequence
tgcctcgcgttggttttccg

SEQ ID NO: 1556 - DNA, 20 bp, Artificial
  20-mer unique DNA sequence
ggatggattgggcgttgagg

SEQ ID NO: 1557 - DNA, 20 bp, Artificial
  20-mer unique DNA sequence
acgagacacgggcccagcag

SEQ ID NO: 1558 - DNA, 20 bp, Artificial
  20-mer unique DNA sequence
tgatccgtgcgtgggtgaag

SEQ ID NO: 1559 - DNA, 20 bp, Artificial
  20-mer unique DNA sequence
tgctgattggccccgtaccc

SEQ ID NO: 1560 - DNA, 20 bp, Artificial
  20-mer unique DNA sequence
ctcatcccgccgcaacgtta

SEQ ID NO: 1561 - DNA, 20 bp, Artificial
  20-mer unique DNA sequence
gcatgcggcgttttcctttg

SEQ ID NO: 1562 - DNA, 20 bp, Artificial
  20-mer unique DNA sequence
tttgggggtttggggacgtt

SEQ ID NO: 1563 - DNA, 20 bp, Artificial
  20-mer unique DNA sequence
cggagttgctttcggatcgg

SEQ ID NO: 1564 - DNA, 20 bp, Artificial
  20-mer unique DNA sequence
gcacagacgcggacatgacg

SEQ ID NO: 1565 - DNA, 20 bp, Artificial
  20-mer unique DNA sequence
cccccgcccctaaaagaacc

SEQ ID NO: 1566 - DNA, 20 bp, Artificial
  20-mer unique DNA sequence
gtggagaaatcacggggggc

SEQ ID NO: 1567 - DNA, 20 bp, Artificial
  20-mer unique DNA sequence
aggggacggaaggagacggg

SEQ ID NO: 1568 - DNA, 20 bp, Artificial
  20-mer unique DNA sequence
acgccgcacaaacacagggc

SEQ ID NO: 1569 - DNA, 20 bp, Artificial
  20-mer unique DNA sequence
tcccgccatcactcttccag

SEQ ID NO: 1570 - DNA, 20 bp, Artificial
  20-mer unique DNA sequence
cgctgccaagcgaaacggtc

SEQ ID NO: 1571 - DNA, 20 bp, Artificial
  20-mer unique DNA sequence
acctttaagttcgcgcgccg

SEQ ID NO: 1572 - DNA, 20 bp, Artificial
  20-mer unique DNA sequence
tactgcccgatccctgctgc

SEQ ID NO: 1573 - DNA, 20 bp, Artificial
  20-mer unique DNA sequence
attaggtattcccgggcgcc

SEQ ID NO: 1574 - DNA, 20 bp, Artificial
  20-mer unique DNA sequence
aacctctatccccagcgccc

SEQ ID NO: 1575 - DNA, 20 bp, Artificial
  20-mer unique DNA sequence
acccataagccgccacagaa

SEQ ID NO: 1576 - DNA, 20 bp, Artificial
  20-mer unique DNA sequence
atgggacggggtgattctcg

SEQ ID NO: 1577 - DNA, 20 bp, Artificial
  20-mer unique DNA sequence
gccgagggttggggagtgtg

SEQ ID NO: 1578 - DNA, 20 bp, Artificial
  20-mer unique DNA sequence
gcccacgacgaccaagatcc

SEQ ID NO: 1579 - DNA, 20 bp, Artificial
  20-mer unique DNA sequence
ccaaaccgacaaaacgcgaa

SEQ ID NO: 1580 - DNA, 20 bp, Artificial
  20-mer unique DNA sequence
ctttcgggggctaacgggct

SEQ ID NO: 1581 - DNA, 20 bp, Artificial
  20-mer unique DNA sequence
acactattgcttccgcccgc

SEQ ID NO: 1582 - DNA, 20 bp, Artificial
  20-mer unique DNA sequence
gtcctcgtttaaccccccgg

SEQ ID NO: 1583 - DNA, 20 bp, Artificial
  20-mer unique DNA sequence
acgctgtcccctaccgcctc

SEQ ID NO: 1584 - DNA, 20 bp, Artificial
  20-mer unique DNA sequence
atgagttcccgcgacgccct

SEQ ID NO: 1585 - DNA, 20 bp, Artificial
  20-mer unique DNA sequence
cgccgaagtgctccaaggat

SEQ ID NO: 1586 - DNA, 20 bp, Artificial
  20-mer unique DNA sequence
agcaggcgggaggttacgag

SEQ ID NO: 1587 - DNA, 20 bp, Artificial
  20-mer unique DNA sequence
cccagaaaggcgcatcgaac

SEQ ID NO: 1588 - DNA, 20 bp, Artificial
  20-mer unique DNA sequence
aacccggacgagcgaattgt

SEQ ID NO: 1589 - DNA, 20 bp, Artificial
  20-mer unique DNA sequence
gccagcacccccatttcatt

SEQ ID NO: 1590 - DNA, 20 bp, Artificial
  20-mer unique DNA sequence
cgacctctaatgctcccggg

SEQ ID NO: 1591 - DNA, 20 bp, Artificial
  20-mer unique DNA sequence
acggctcacaaacggctgcg

SEQ ID NO: 1592 - DNA, 20 bp, Artificial
  20-mer unique DNA sequence
tgtcttcaaccccaccccga

SEQ ID NO: 1593 - DNA, 20 bp, Artificial
  20-mer unique DNA sequence
gtgggcggttttttttgcgt

SEQ ID NO: 1594 - DNA, 20 bp, Artificial
  20-mer unique DNA sequence
cgcggggaagtagggagcac

SEQ ID NO: 1595 - DNA, 20 bp, Artificial
  20-mer unique DNA sequence
agtgggcgaaaggtttggaa

SEQ ID NO: 1596 - DNA, 20 bp, Artificial
  20-mer unique DNA sequence
cctgggctgatcgttcggtt

SEQ ID NO: 1597 - DNA, 20 bp, Artificial
  20-mer unique DNA sequence
ctgtgctcgcctttcgctcc

SEQ ID NO: 1598 - DNA, 20 bp, Artificial
  20-mer unique DNA sequence
tctcctcgcccgctttgttg

SEQ ID NO: 1599 - DNA, 20 bp, Artificial
  20-mer unique DNA sequence
cggccaccttcccattagcg

SEQ ID NO: 1600 - DNA, 20 bp, Artificial
  20-mer unique DNA sequence
gagaaaaggcccgcgtcgac

SEQ ID NO: 1601 - DNA, 20 bp, Artificial
  20-mer unique DNA sequence
tgagcgagagcgtgaggagc

SEQ ID NO: 1602 - DNA, 20 bp, Artificial
  20-mer unique DNA sequence
ttggacggaaaagctggggt

SEQ ID NO: 1603 - DNA, 20 bp, Artificial
  20-mer unique DNA sequence
cgaattcagtagcaccgcgg

SEQ ID NO: 1604 - DNA, 20 bp, Artificial
  20-mer unique DNA sequence
tccattgccacgagttcccc

SEQ ID NO: 1605 - DNA, 20 bp, Artificial
  20-mer unique DNA sequence
cccccccactcgctatccag

SEQ ID NO: 1606 - DNA, 20 bp, Artificial
  20-mer unique DNA sequence
ggctccaccctaggtccgct

SEQ ID NO: 1607 - DNA, 20 bp, Artificial
  20-mer unique DNA sequence
cgataaaatcatggcccccg

SEQ ID NO: 1608 - DNA, 20 bp, Artificial
  20-mer unique DNA sequence
caagcgggcccagagaatgt

SEQ ID NO: 1609 - DNA, 20 bp, Artificial
  20-mer unique DNA sequence
cgcgcccggttgttttcttt

SEQ ID NO: 1610 - DNA, 20 bp, Artificial
  20-mer unique DNA sequence
ggcacggcagaacgcaatgt

SEQ ID NO: 1611 - DNA, 20 bp, Artificial
  20-mer unique DNA sequence
tgcaagatccccagcccgtc

SEQ ID NO: 1612 - DNA, 20 bp, Artificial
  20-mer unique DNA sequence
gcgcccaccagcagaactca

SEQ ID NO: 1613 - DNA, 20 bp, Artificial
  20-mer unique DNA sequence
ggggggcgggagttttatgc

SEQ ID NO: 1614 - DNA, 20 bp, Artificial
  20-mer unique DNA sequence
agagaggaggggcgcggaca

SEQ ID NO: 1615 - DNA, 20 bp, Artificial
  20-mer unique DNA sequence
gggtgcggatcaattgggtt

SEQ ID NO: 1616 - DNA, 20 bp, Artificial
  20-mer unique DNA sequence
acgcgcgagccccttatgat

SEQ ID NO: 1617 - DNA, 20 bp, Artificial
  20-mer unique DNA sequence
gcagggatcgtgggaacagc

SEQ ID NO: 1618 - DNA, 20 bp, Artificial
  20-mer unique DNA sequence
gctttggagggaggcggcta

SEQ ID NO: 1619 - DNA, 20 bp, Artificial
  20-mer unique DNA sequence
agcgctggttgttcggatcg

SEQ ID NO: 1620 - DNA, 20 bp, Artificial
  20-mer unique DNA sequence
caggtaggccaagtcggggg

SEQ ID NO: 1621 - DNA, 20 bp, Artificial
  20-mer unique DNA sequence
gtgctcgtatccctcccgcc

SEQ ID NO: 1622 - DNA, 20 bp, Artificial
  20-mer unique DNA sequence
cgaggaagcgggcacaaggt

SEQ ID NO: 1623 - DNA, 20 bp, Artificial
  20-mer unique DNA sequence
cgaggcacgcgaaaaacaaa

SEQ ID NO: 1624 - DNA, 20 bp, Artificial
  20-mer unique DNA sequence
gaagcgatgggcaaaagccc

SEQ ID NO: 1625 - DNA, 20 bp, Artificial
  20-mer unique DNA sequence
cttactcgccgctccttggg

SEQ ID NO: 1626 - DNA, 20 bp, Artificial
  20-mer unique DNA sequence
cgagcgaggaagggtgtaat

SEQ ID NO: 1627 - DNA, 20 bp, Artificial
  20-mer unique DNA sequence
ctactcacacaacgcgcgca

SEQ ID NO: 1628 - DNA, 20 bp, Artificial
  20-mer unique DNA sequence
attcggttggcggtaggggt

SEQ ID NO: 1629 - DNA, 20 bp, Artificial
  20-mer unique DNA sequence
gggcgtagaatgaccgaggg

SEQ ID NO: 1630 - DNA, 20 bp, Artificial
  20-mer unique DNA sequence
gcgagggaaatgaaacggcg

SEQ ID NO: 1631 - DNA, 20 bp, Artificial
  20-mer unique DNA sequence
ccccaagcgatcagaaggcg

SEQ ID NO: 1632 - DNA, 20 bp, Artificial
  20-mer unique DNA sequence
cggaggttggcaggcgtgat

SEQ ID NO: 1633 - DNA, 20 bp, Artificial
  20-mer unique DNA sequence
ggagcacacatacgcggggg

SEQ ID NO: 1634 - DNA, 20 bp, Artificial
  20-mer unique DNA sequence
tcatcgacggggggattctg

SEQ ID NO: 1635 - DNA, 20 bp, Artificial
  20-mer unique DNA sequence
gacgtcagaccccccatgga

SEQ ID NO: 1636 - DNA, 20 bp, Artificial
  20-mer unique DNA sequence
gcttggatggccttgggtcg

SEQ ID NO: 1637 - DNA, 20 bp, Artificial
  20-mer unique DNA sequence
tgtcgatcagggggcgtggc

SEQ ID NO: 1638 - DNA, 20 bp, Artificial
  20-mer unique DNA sequence
agactgatgccccccaccgg

SEQ ID NO: 1639 - DNA, 20 bp, Artificial
  20-mer unique DNA sequence
ttcgcgtcaagggtggttcc

SEQ ID NO: 1640 - DNA, 20 bp, Artificial
  20-mer unique DNA sequence
cccaagtaacgcccgccaga

SEQ ID NO: 1641 - DNA, 20 bp, Artificial
  20-mer unique DNA sequence
gcgccctctcttcaccttgg

SEQ ID NO: 1642 - DNA, 20 bp, Artificial
  20-mer unique DNA sequence
tccgggcgccaatatgttcg

SEQ ID NO: 1643 - DNA, 20 bp, Artificial
  20-mer unique DNA sequence
aaccaccccctattcggcca

SEQ ID NO: 1644 - DNA, 20 bp, Artificial
  20-mer unique DNA sequence
atgtcggaaatgtgcgtggc

SEQ ID NO: 1645 - DNA, 20 bp, Artificial
  20-mer unique DNA sequence
ccgatctgcacagcccccaa

SEQ ID NO: 1646 - DNA, 20 bp, Artificial
  20-mer unique DNA sequence
cctcctttttctgccccgcc

SEQ ID NO: 1647 - DNA, 20 bp, Artificial
  20-mer unique DNA sequence
ggcggtagggatgaggggaa

SEQ ID NO: 1648 - DNA, 20 bp, Artificial
  20-mer unique DNA sequence
cgcctcccgtatgaactcct

SEQ ID NO: 1649 - DNA, 20 bp, Artificial
  20-mer unique DNA sequence
tcgcgctgctcccccactta

SEQ ID NO: 1650 - DNA, 20 bp, Artificial
  20-mer unique DNA sequence
atctcccccgtctcgcgcat

SEQ ID NO: 1651 - DNA, 20 bp, Artificial
  20-mer unique DNA sequence
gcggggggacttatcgatgg

SEQ ID NO: 1652 - DNA, 20 bp, Artificial
  20-mer unique DNA sequence
ggggttgctcttggctgtcg

SEQ ID NO: 1653 - DNA, 20 bp, Artificial
  20-mer unique DNA sequence
tcaagaaggcatgcgaccgg

SEQ ID NO: 1654 - DNA, 20 bp, Artificial
  20-mer unique DNA sequence
tgccgtggggtgggtgaatt

SEQ ID NO: 1655 - DNA, 20 bp, Artificial
  20-mer unique DNA sequence
aaactgggagcgctgcaacg

SEQ ID NO: 1656 - DNA, 20 bp, Artificial
  20-mer unique DNA sequence
ctaacccccccctgccggct

SEQ ID NO: 1657 - DNA, 20 bp, Artificial
  20-mer unique DNA sequence
cagtgccgaacaaagcgagg

SEQ ID NO: 1658 - DNA, 20 bp, Artificial
  20-mer unique DNA sequence
cgggcccagttccttttgac

SEQ ID NO: 1659 - DNA, 20 bp, Artificial
  20-mer unique DNA sequence
attgggtcggcaggaacgtc

SEQ ID NO: 1660 - DNA, 20 bp, Artificial
  20-mer unique DNA sequence
gccccacatgccggtgtaag

SEQ ID NO: 1661 - DNA, 20 bp, Artificial
  20-mer unique DNA sequence
acctgtgtgcctatcggcgg

SEQ ID NO: 1662 - DNA, 20 bp, Artificial
  20-mer unique DNA sequence
acgttggcgtcagtcgatga

SEQ ID NO: 1663 - DNA, 20 bp, Artificial
  20-mer unique DNA sequence
agacagtcggcgcgatagga

SEQ ID NO: 1664 - DNA, 20 bp, Artificial
  20-mer unique DNA sequence
agctcttaattgccggcccc

SEQ ID NO: 1665 - DNA, 20 bp, Artificial
  20-mer unique DNA sequence
ttaccctgacctgcgcccga

SEQ ID NO: 1666 - DNA, 20 bp, Artificial
  20-mer unique DNA sequence
atgcaagcgtgtcgtaagga

SEQ ID NO: 1667 - DNA, 20 bp, Artificial
  20-mer unique DNA sequence
ggcttatggcgggtgcgagt

SEQ ID NO: 1668 - DNA, 20 bp, Artificial
  20-mer unique DNA sequence
acccgtatccccgcctgctg

SEQ ID NO: 1669 - DNA, 20 bp, Artificial
  20-mer unique DNA sequence
catttcgagtgggggtccgc

SEQ ID NO: 1670 - DNA, 20 bp, Artificial
  20-mer unique DNA sequence
ctcgtgggaagcgtcaagcc

SEQ ID NO: 1671 - DNA, 20 bp, Artificial
  20-mer unique DNA sequence
aggaaggatgcagccagcga

SEQ ID NO: 1672 - DNA, 20 bp, Artificial
  20-mer unique DNA sequence
gggcgggctcgtgcaagatt

SEQ ID NO: 1673 - DNA, 20 bp, Artificial
  20-mer unique DNA sequence
ctcaccccctgcatacacaa

SEQ ID NO: 1674 - DNA, 20 bp, Artificial
  20-mer unique DNA sequence
ctggtgctgggctcatgggc

SEQ ID NO: 1675 - DNA, 20 bp, Artificial
  20-mer unique DNA sequence
aattgtcacggcgcccaagc

SEQ ID NO: 1676 - DNA, 20 bp, Artificial
  20-mer unique DNA sequence
ccgggcccattcatcctgta

SEQ ID NO: 1677 - DNA, 20 bp, Artificial
  20-mer unique DNA sequence
gactgggacgaggcgcttgg

SEQ ID NO: 1678 - DNA, 20 bp, Artificial
  20-mer unique DNA sequence
cgaagcagcaagacaacgcc

SEQ ID NO: 1679 - DNA, 20 bp, Artificial
  20-mer unique DNA sequence
agcccccggtagtcccaaga

SEQ ID NO: 1680 - DNA, 20 bp, Artificial
  20-mer unique DNA sequence
ccccacacatatccacgccc

SEQ ID NO: 1681 - DNA, 20 bp, Artificial
  20-mer unique DNA sequence
actgcattaccttccccgcg

SEQ ID NO: 1682 - DNA, 20 bp, Artificial
  20-mer unique DNA sequence
tctgggtctacgtgaacggc

SEQ ID NO: 1683 - DNA, 20 bp, Artificial
  20-mer unique DNA sequence
atgagcgcacgcgactcaat

SEQ ID NO: 1684 - DNA, 20 bp, Artificial
  20-mer unique DNA sequence
cggccgcaggacaaagtggg

SEQ ID NO: 1685 - DNA, 20 bp, Artificial
  20-mer unique DNA sequence
gacacctcccacccaccgca

SEQ ID NO: 1686 - DNA, 20 bp, Artificial
  20-mer unique DNA sequence
aacggcggggaccataacaa

SEQ ID NO: 1687 - DNA, 20 bp, Artificial
  20-mer unique DNA sequence
ccgtcattctcctttggccc

SEQ ID NO: 1688 - DNA, 20 bp, Artificial
  20-mer unique DNA sequence
acccgccacgcaagtcaatg

SEQ ID NO: 1689 - DNA, 20 bp, Artificial
  20-mer unique DNA sequence
cgaagaccacgggggaaaag

SEQ ID NO: 1690 - DNA, 20 bp, Artificial
  20-mer unique DNA sequence
tgagaccgcccatgcctgta

SEQ ID NO: 1691 - DNA, 20 bp, Artificial
  20-mer unique DNA sequence
gccgacccctaccctcccat

SEQ ID NO: 1692 - DNA, 20 bp, Artificial
  20-mer unique DNA sequence
ttgcggatttgcggtgagac

SEQ ID NO: 1693 - DNA, 20 bp, Artificial
  20-mer unique DNA sequence
cgtcgtgataggggtgggct

SEQ ID NO: 1694 - DNA, 20 bp, Artificial
  20-mer unique DNA sequence
tgcacgcccacaacccatac

SEQ ID NO: 1695 - DNA, 20 bp, Artificial
  20-mer unique DNA sequence
gaggagcattggcggaacgt

SEQ ID NO: 1696 - DNA, 20 bp, Artificial
  20-mer unique DNA sequence
tgacgactttgaccgccctg

SEQ ID NO: 1697 - DNA, 20 bp, Artificial
  20-mer unique DNA sequence
ggatgcttgcgggtggttca

SEQ ID NO: 1698 - DNA, 20 bp, Artificial
  20-mer unique DNA sequence
aggcggagattttggagggc

SEQ ID NO: 1699 - DNA, 20 bp, Artificial
  20-mer unique DNA sequence
actcctcggagggggtgttt

SEQ ID NO: 1700 - DNA, 20 bp, Artificial
  20-mer unique DNA sequence
aatcgcacacggagcaatgc

SEQ ID NO: 1701 - DNA, 20 bp, Artificial
  20-mer unique DNA sequence
cattggttcctttccgcggg

SEQ ID NO: 1702 - DNA, 20 bp, Artificial
  20-mer unique DNA sequence
agccaaaggaggcaaggggc

SEQ ID NO: 1703 - DNA, 20 bp, Artificial
  20-mer unique DNA sequence
caagccgacccaccaggcag

SEQ ID NO: 1704 - DNA, 20 bp, Artificial
  20-mer unique DNA sequence
ttaggtggtgtgctgcggga

SEQ ID NO: 1705 - DNA, 20 bp, Artificial
  20-mer unique DNA sequence
ggatgacccgcaacagacgc

SEQ ID NO: 1706 - DNA, 20 bp, Artificial
  20-mer unique DNA sequence
acccgcgcaggctataggaa

SEQ ID NO: 1707 - DNA, 20 bp, Artificial
  20-mer unique DNA sequence
ttatcccacagccaccgcct

SEQ ID NO: 1708 - DNA, 20 bp, Artificial
  20-mer unique DNA sequence
aagctagtcgctaagcgggc

SEQ ID NO: 1709 - DNA, 20 bp, Artificial
  20-mer unique DNA sequence
ggagcgtaccgagcctgttt

SEQ ID NO: 1710 - DNA, 20 bp, Artificial
  20-mer unique DNA sequence
gtgacgggagagcggaagcg

SEQ ID NO: 1711 - DNA, 20 bp, Artificial
  20-mer unique DNA sequence
gggctgagttgtccggcgtt

SEQ ID NO: 1712 - DNA, 20 bp, Artificial
  20-mer unique DNA sequence
gcacttttcgtcctcggcca

SEQ ID NO: 1713 - DNA, 20 bp, Artificial
  20-mer unique DNA sequence
gtgagcgcgggagggagtct

SEQ ID NO: 1714 - DNA, 20 bp, Artificial
  20-mer unique DNA sequence
tggggaaagcgggatggact

SEQ ID NO: 1715 - DNA, 20 bp, Artificial
  20-mer unique DNA sequence
attcccgccctagcctccgt

SEQ ID NO: 1716 - DNA, 20 bp, Artificial
  20-mer unique DNA sequence
cggcggcaatggtggtactc

SEQ ID NO: 1717 - DNA, 20 bp, Artificial
  20-mer unique DNA sequence
acagacgccgcaatcaccag

SEQ ID NO: 1718 - DNA, 20 bp, Artificial
  20-mer unique DNA sequence
agtgatgggaactgggcggt

SEQ ID NO: 1719 - DNA, 20 bp, Artificial
  20-mer unique DNA sequence
cagggggggcgatgtgtgct

SEQ ID NO: 1720 - DNA, 20 bp, Artificial
  20-mer unique DNA sequence
ggcgcgcgtagtggagatct

SEQ ID NO: 1721 - DNA, 20 bp, Artificial
  20-mer unique DNA sequence
gctccgaagaattgcccccc

SEQ ID NO: 1722 - DNA, 20 bp, Artificial
  20-mer unique DNA sequence
tggcaatcccccgaaagcat

SEQ ID NO: 1723 - DNA, 20 bp, Artificial
  20-mer unique DNA sequence
aaacaccccgctaccacgca

SEQ ID NO: 1724 - DNA, 20 bp, Artificial
  20-mer unique DNA sequence
gccgggacgagacctatgcg

SEQ ID NO: 1725 - DNA, 20 bp, Artificial
  20-mer unique DNA sequence
ctcgccagcttaacgccctc

SEQ ID NO: 1726 - DNA, 20 bp, Artificial
  20-mer unique DNA sequence
gccgaccaatgcaccgctaa

SEQ ID NO: 1727 - DNA, 20 bp, Artificial
  20-mer unique DNA sequence
ctggtgtggggtggagagca

SEQ ID NO: 1728 - DNA, 20 bp, Artificial
  20-mer unique DNA sequence
cctattggtccccgccctga

SEQ ID NO: 1729 - DNA, 20 bp, Artificial
  20-mer unique DNA sequence
cttggcggggggctataacg

SEQ ID NO: 1730 - DNA, 20 bp, Artificial
  20-mer unique DNA sequence
tcccccttgaacccatccaa

SEQ ID NO: 1731 - DNA, 20 bp, Artificial
  20-mer unique DNA sequence
ccctcaccgccgatttttcc

SEQ ID NO: 1732 - DNA, 20 bp, Artificial
  20-mer unique DNA sequence
gagtgcggagatggcgaggt

SEQ ID NO: 1733 - DNA, 20 bp, Artificial
  20-mer unique DNA sequence
gtgtcccgccaccccctcgg

SEQ ID NO: 1734 - DNA, 20 bp, Artificial
  20-mer unique DNA sequence
gccaaatcggtgaagtgcca

SEQ ID NO: 1735 - DNA, 20 bp, Artificial
  20-mer unique DNA sequence
cgaaccccacaccgatagca

SEQ ID NO: 1736 - DNA, 20 bp, Artificial
  20-mer unique DNA sequence
gccccccgatccagcttact

SEQ ID NO: 1737 - DNA, 20 bp, Artificial
  20-mer unique DNA sequence
gcgatggagggacgttgtcg

SEQ ID NO: 1738 - DNA, 20 bp, Artificial
  20-mer unique DNA sequence
cgccctcagacgccaattcc

SEQ ID NO: 1739 - DNA, 20 bp, Artificial
  20-mer unique DNA sequence
cgcccatgcagatccaagcc

SEQ ID NO: 1740 - DNA, 20 bp, Artificial
  20-mer unique DNA sequence
tagcccgccaacgcactgac

SEQ ID NO: 1741 - DNA, 20 bp, Artificial
  20-mer unique DNA sequence
cgggagcggagccaatcaga

SEQ ID NO: 1742 - DNA, 20 bp, Artificial
  20-mer unique DNA sequence
ctggcgcccgtaaagagtgg

SEQ ID NO: 1743 - DNA, 20 bp, Artificial
  20-mer unique DNA sequence
atgtcgctctcccgtgaccg

SEQ ID NO: 1744 - DNA, 20 bp, Artificial
  20-mer unique DNA sequence
aactggcctgctatgcggcg

SEQ ID NO: 1745 - DNA, 20 bp, Artificial
  20-mer unique DNA sequence
tcgggctgaggtttgcggag

SEQ ID NO: 1746 - DNA, 20 bp, Artificial
  20-mer unique DNA sequence
tcacaggagggcgcaagcat

SEQ ID NO: 1747 - DNA, 20 bp, Artificial
  20-mer unique DNA sequence
ctcgccgctaatttcccccg

SEQ ID NO: 1748 - DNA, 20 bp, Artificial
  20-mer unique DNA sequence
gaagaatgtcgccggcctgg

SEQ ID NO: 1749 - DNA, 20 bp, Artificial
  20-mer unique DNA sequence
taccgcacccccaaacaggc

SEQ ID NO: 1750 - DNA, 20 bp, Artificial
  20-mer unique DNA sequence
atgtggagggtggcagagcc

SEQ ID NO: 1751 - DNA, 20 bp, Artificial
  20-mer unique DNA sequence
tgcctagcatccccacacgg

SEQ ID NO: 1752 - DNA, 20 bp, Artificial
  20-mer unique DNA sequence
agcgggtggtgaggaaggca

SEQ ID NO: 1753 - DNA, 20 bp, Artificial
  20-mer unique DNA sequence
ggggatcaggcctcaaacga

SEQ ID NO: 1754 - DNA, 20 bp, Artificial
  20-mer unique DNA sequence
cctccccaactacggtccca

SEQ ID NO: 1755 - DNA, 20 bp, Artificial
  20-mer unique DNA sequence
cagttagcggatgagggcgg

SEQ ID NO: 1756 - DNA, 20 bp, Artificial
  20-mer unique DNA sequence
agcgatgaagaacggtggcg

SEQ ID NO: 1757 - DNA, 20 bp, Artificial
  20-mer unique DNA sequence
tccactcgcacctcaccccc

SEQ ID NO: 1758 - DNA, 20 bp, Artificial
  20-mer unique DNA sequence
ctcatgccgtccgaaaggga

SEQ ID NO: 1759 - DNA, 20 bp, Artificial
  20-mer unique DNA sequence
tatggggcagggggggaatt

SEQ ID NO: 1760 - DNA, 20 bp, Artificial
  20-mer unique DNA sequence
tcccacctgctgacccgctt

SEQ ID NO: 1761 - DNA, 20 bp, Artificial
  20-mer unique DNA sequence
ttatcccccgcgctatgtgc

SEQ ID NO: 1762 - DNA, 20 bp, Artificial
  20-mer unique DNA sequence
ggcgggtgggggttcgtaag

SEQ ID NO: 1763 - DNA, 20 bp, Artificial
  20-mer unique DNA sequence
aggtgcaaggccaagcgatg

SEQ ID NO: 1764 - DNA, 20 bp, Artificial
  20-mer unique DNA sequence
gggttgcttcgcgctattgc

SEQ ID NO: 1765 - DNA, 20 bp, Artificial
  20-mer unique DNA sequence
cccgcctttcactcccagcc

SEQ ID NO: 1766 - DNA, 20 bp, Artificial
  20-mer unique DNA sequence
caaagtgcggatctttgagt

SEQ ID NO: 1767 - DNA, 20 bp, Artificial
  20-mer unique DNA sequence
gcctgcccacaggctaactt

SEQ ID NO: 1768 - DNA, 20 bp, Artificial
  20-mer unique DNA sequence
caacggacgcaccacaggac

SEQ ID NO: 1769 - DNA, 20 bp, Artificial
  20-mer unique DNA sequence
gcgtgcgggaaggtgtgaaa

SEQ ID NO: 1770 - DNA, 20 bp, Artificial
  20-mer unique DNA sequence
ccggtccaataaggggctga

SEQ ID NO: 1771 - DNA, 20 bp, Artificial
  20-mer unique DNA sequence
agggagcatcggcaaatcgg

SEQ ID NO: 1772 - DNA, 20 bp, Artificial
  20-mer unique DNA sequence
ctggcgtggatgcgttcgtg

SEQ ID NO: 1773 - DNA, 20 bp, Artificial
  20-mer unique DNA sequence
aaaaaacttaccggccgcgc

SEQ ID NO: 1774 - DNA, 20 bp, Artificial
  20-mer unique DNA sequence
gcgggtgcgggtcgtttata

SEQ ID NO: 1775 - DNA, 20 bp, Artificial
  20-mer unique DNA sequence
ctgcaacgtgaaagagcggg

SEQ ID NO: 1776 - DNA, 20 bp, Artificial
  20-mer unique DNA sequence
gttcccgtttttgcgttgcc

SEQ ID NO: 1777 - DNA, 20 bp, Artificial
  20-mer unique DNA sequence
gagaagccgccccatcacat

SEQ ID NO: 1778 - DNA, 20 bp, Artificial
  20-mer unique DNA sequence
gcctaccaactcgccatgca

SEQ ID NO: 1779 - DNA, 20 bp, Artificial
  20-mer unique DNA sequence
tgggtgggcgagttgttgct

SEQ ID NO: 1780 - DNA, 20 bp, Artificial
  20-mer unique DNA sequence
cgcccgtatttgcttgtcgc

SEQ ID NO: 1781 - DNA, 20 bp, Artificial
  20-mer unique DNA sequence
cggcggggggtgacagctat

SEQ ID NO: 1782 - DNA, 20 bp, Artificial
  20-mer unique DNA sequence
ggtgtcagtggtgggggtcg

SEQ ID NO: 1783 - DNA, 20 bp, Artificial
  20-mer unique DNA sequence
gacgcgagccctacacacgg

SEQ ID NO: 1784 - DNA, 20 bp, Artificial
  20-mer unique DNA sequence
cgtttcatgaagtgcggccg

SEQ ID NO: 1785 - DNA, 20 bp, Artificial
  20-mer unique DNA sequence
atgctgtatgcgtaaggggc

SEQ ID NO: 1786 - DNA, 20 bp, Artificial
  20-mer unique DNA sequence
ttaatggatgttcgcggccc

SEQ ID NO: 1787 - DNA, 20 bp, Artificial
  20-mer unique DNA sequence
gcttgcctgttctcgctggg

SEQ ID NO: 1788 - DNA, 20 bp, Artificial
  20-mer unique DNA sequence
tagggagggcgatgcagggg

SEQ ID NO: 1789 - DNA, 20 bp, Artificial
  20-mer unique DNA sequence
tagggtatggggggacggca

SEQ ID NO: 1790 - DNA, 20 bp, Artificial
  20-mer unique DNA sequence
tgagatttgagcggggcagg

SEQ ID NO: 1791 - DNA, 20 bp, Artificial
  20-mer unique DNA sequence
accagtccgccaaatcgtcc

SEQ ID NO: 1792 - DNA, 20 bp, Artificial
  20-mer unique DNA sequence
cacccccgctacaaatcgcc

SEQ ID NO: 1793 - DNA, 20 bp, Artificial
  20-mer unique DNA sequence
atagtggcgcctggggaaga

SEQ ID NO: 1794 - DNA, 20 bp, Artificial
  20-mer unique DNA sequence
accctttgctcggccactgc

SEQ ID NO: 1795 - DNA, 20 bp, Artificial
  20-mer unique DNA sequence
gcaaaaagcacggggccata

SEQ ID NO: 1796 - DNA, 20 bp, Artificial
  20-mer unique DNA sequence
taaatgctaatcgccggtcg

SEQ ID NO: 1797 - DNA, 20 bp, Artificial
  20-mer unique DNA sequence
aaccgcccgctaagtccccc

SEQ ID NO: 1798 - DNA, 20 bp, Artificial
  20-mer unique DNA sequence
tgctcgcgcccacgtatact

SEQ ID NO: 1799 - DNA, 20 bp, Artificial
  20-mer unique DNA sequence
aagatcaaccgcctcccccc

SEQ ID NO: 1800 - DNA, 20 bp, Artificial
  20-mer unique DNA sequence
tagtgccgtgaaccccgact

SEQ ID NO: 1801 - DNA, 20 bp, Artificial
  20-mer unique DNA sequence
atccgtcacataggccggga

SEQ ID NO: 1802 - DNA, 20 bp, Artificial
  20-mer unique DNA sequence
caacccctcccgcactaccc

SEQ ID NO: 1803 - DNA, 20 bp, Artificial
  20-mer unique DNA sequence
gaggcaccgcagaaccacga

SEQ ID NO: 1804 - DNA, 20 bp, Artificial
  20-mer unique DNA sequence
caaccaaagtcagcgggcaa

SEQ ID NO: 1805 - DNA, 20 bp, Artificial
  20-mer unique DNA sequence
cgcaacccacactcggacag

SEQ ID NO: 1806 - DNA, 20 bp, Artificial
  20-mer unique DNA sequence
gcggaatgggcgtgtgtgtt

SEQ ID NO: 1807 - DNA, 20 bp, Artificial
  20-mer unique DNA sequence
tttgtggaatggggaccggg

SEQ ID NO: 1808 - DNA, 20 bp, Artificial
  20-mer unique DNA sequence
ccgcaacgacctcagcccta

SEQ ID NO: 1809 - DNA, 20 bp, Artificial
  20-mer unique DNA sequence
aaccaggggaaggtgccgag

SEQ ID NO: 1810 - DNA, 20 bp, Artificial
  20-mer unique DNA sequence
tttacgggggaacgcagggg

SEQ ID NO: 1811 - DNA, 20 bp, Artificial
  20-mer unique DNA sequence
gcgaaagggacaaggcatgc

SEQ ID NO: 1812 - DNA, 20 bp, Artificial
  20-mer unique DNA sequence
tgacggggcgagggctaagg

SEQ ID NO: 1813 - DNA, 20 bp, Artificial
  20-mer unique DNA sequence
agcatactgccccgtcaaac

SEQ ID NO: 1814 - DNA, 20 bp, Artificial
  20-mer unique DNA sequence
ccgcctgctcgccttagtcc

SEQ ID NO: 1815 - DNA, 20 bp, Artificial
  20-mer unique DNA sequence
ttgccgcttcccagactcct

SEQ ID NO: 1816 - DNA, 20 bp, Artificial
  20-mer unique DNA sequence
cacatgtctccgcgcccaag

SEQ ID NO: 1817 - DNA, 20 bp, Artificial
  20-mer unique DNA sequence
atcgccagttgccccgctta

SEQ ID NO: 1818 - DNA, 20 bp, Artificial
  20-mer unique DNA sequence
gctatccccgcgcacattcc

SEQ ID NO: 1819 - DNA, 20 bp, Artificial
  20-mer unique DNA sequence
gatcccaacgccagcagcat

SEQ ID NO: 1820 - DNA, 20 bp, Artificial
  20-mer unique DNA sequence
ctatcgccgcacaccacagg

SEQ ID NO: 1821 - DNA, 20 bp, Artificial
  20-mer unique DNA sequence
atcagtccacgcgtttgcca

SEQ ID NO: 1822 - DNA, 20 bp, Artificial
  20-mer unique DNA sequence
ggtcgcgccaaacgttcagt

SEQ ID NO: 1823 - DNA, 20 bp, Artificial
  20-mer unique DNA sequence
caccagcaaaacgcacagcg

SEQ ID NO: 1824 - DNA, 20 bp, Artificial
  20-mer unique DNA sequence
aggtaattgtcgtgcggcgg

SEQ ID NO: 1825 - DNA, 20 bp, Artificial
  20-mer unique DNA sequence
tcacagcccatcagccctcg

SEQ ID NO: 1826 - DNA, 20 bp, Artificial
  20-mer unique DNA sequence
cggaagcgcatcaggaacaa

SEQ ID NO: 1827 - DNA, 20 bp, Artificial
  20-mer unique DNA sequence
ttaatcctccggcccacccc

SEQ ID NO: 1828 - DNA, 20 bp, Artificial
  20-mer unique DNA sequence
gttgtctgttttcccgcgcc

SEQ ID NO: 1829 - DNA, 20 bp, Artificial
  20-mer unique DNA sequence
ccgtccagtcaagccgtcaa

SEQ ID NO: 1830 - DNA, 20 bp, Artificial
  20-mer unique DNA sequence
tcaactatccatggcccgta

SEQ ID NO: 1831 - DNA, 20 bp, Artificial
  20-mer unique DNA sequence
cttcggcgctgtggagttca

SEQ ID NO: 1832 - DNA, 20 bp, Artificial
  20-mer unique DNA sequence
gacaacaaccgcccgacgat

SEQ ID NO: 1833 - DNA, 20 bp, Artificial
  20-mer unique DNA sequence
cggtaagagggcacatgggc

SEQ ID NO: 1834 - DNA, 20 bp, Artificial
  20-mer unique DNA sequence
aaggtgggaagccggaggac

SEQ ID NO: 1835 - DNA, 20 bp, Artificial
  20-mer unique DNA sequence
tgtggggggatggaacgtgg

SEQ ID NO: 1836 - DNA, 20 bp, Artificial
  20-mer unique DNA sequence
gcagcacccctccgttccat

SEQ ID NO: 1837 - DNA, 20 bp, Artificial
  20-mer unique DNA sequence
acttgaggcatggggatcgg

SEQ ID NO: 1838 - DNA, 20 bp, Artificial
  20-mer unique DNA sequence
cctacccaccgcgccaaaca

SEQ ID NO: 1839 - DNA, 20 bp, Artificial
  20-mer unique DNA sequence
atggcctcgggtaacaagcg

SEQ ID NO: 1840 - DNA, 20 bp, Artificial
  20-mer unique DNA sequence
attgcgtagtccccggcctc

SEQ ID NO: 1841 - DNA, 20 bp, Artificial
  20-mer unique DNA sequence
ttccgcgcttaattgacccc

SEQ ID NO: 1842 - DNA, 20 bp, Artificial
  20-mer unique DNA sequence
gttagttggcccccgcggta

SEQ ID NO: 1843 - DNA, 20 bp, Artificial
  20-mer unique DNA sequence
ctggtgcgatcgtgtgagcg

SEQ ID NO: 1844 - DNA, 20 bp, Artificial
  20-mer unique DNA sequence
cccctatgcccaacgccact

SEQ ID NO: 1845 - DNA, 20 bp, Artificial
  20-mer unique DNA sequence
cccttggcccggttaacaca

SEQ ID NO: 1846 - DNA, 20 bp, Artificial
  20-mer unique DNA sequence
tcgcttccaattcggccgtg

SEQ ID NO: 1847 - DNA, 20 bp, Artificial
  20-mer unique DNA sequence
cgcctctcgtgtgatcgtcc

SEQ ID NO: 1848 - DNA, 20 bp, Artificial
  20-mer unique DNA sequence
gattaagccaaaagccgccg

SEQ ID NO: 1849 - DNA, 20 bp, Artificial
  20-mer unique DNA sequence
cgaaattggactgccccctc

SEQ ID NO: 1850 - DNA, 20 bp, Artificial
  20-mer unique DNA sequence
gtcccgtaacccctgcatgc

SEQ ID NO: 1851 - DNA, 20 bp, Artificial
  20-mer unique DNA sequence
ctcgaagtcccctcccgcct

SEQ ID NO: 1852 - DNA, 20 bp, Artificial
  20-mer unique DNA sequence
ggactacccacggccgcaac

SEQ ID NO: 1853 - DNA, 20 bp, Artificial
  20-mer unique DNA sequence
agcgcgcaattaacgtggaa

SEQ ID NO: 1854 - DNA, 20 bp, Artificial
  20-mer unique DNA sequence
tctcggatgggacggtggct

SEQ ID NO: 1855 - DNA, 20 bp, Artificial
  20-mer unique DNA sequence
gacaagtgaagcggggagcc

SEQ ID NO: 1856 - DNA, 20 bp, Artificial
  20-mer unique DNA sequence
tgtacgctctaggtgccacg

SEQ ID NO: 1857 - DNA, 20 bp, Artificial
  20-mer unique DNA sequence
gagactgcgtaggccgacat

SEQ ID NO: 1858 - DNA, 20 bp, Artificial
  20-mer unique DNA sequence
tcgccggagctcccttaaca

SEQ ID NO: 1859 - DNA, 20 bp, Artificial
  20-mer unique DNA sequence
ttcgctttcgttaccgggct

SEQ ID NO: 1860 - DNA, 20 bp, Artificial
  20-mer unique DNA sequence
agagagaccgagcctcgcat

SEQ ID NO: 1861 - DNA, 20 bp, Artificial
  20-mer unique DNA sequence
cgcgcaccattaagcaaccg

SEQ ID NO: 1862 - DNA, 20 bp, Artificial
  20-mer unique DNA sequence
agccacatgggatccgcctt

SEQ ID NO: 1863 - DNA, 20 bp, Artificial
  20-mer unique DNA sequence
aacggcttacctacggcctc

SEQ ID NO: 1864 - DNA, 20 bp, Artificial
  20-mer unique DNA sequence
tcaagccgatctgacgggtg

SEQ ID NO: 1865 - DNA, 20 bp, Artificial
  20-mer unique DNA sequence
ggaagtggggccgtaaagcg

SEQ ID NO: 1866 - DNA, 20 bp, Artificial
  20-mer unique DNA sequence
acgacagcgatctcctgggt

SEQ ID NO: 1867 - DNA, 20 bp, Artificial
  20-mer unique DNA sequence
tcctgtccgtatgctgtcgc

SEQ ID NO: 1868 - DNA, 20 bp, Artificial
  20-mer unique DNA sequence
tatctgcagcgctatgggcg

SEQ ID NO: 1869 - DNA, 20 bp, Artificial
  20-mer unique DNA sequence
atggcgtgcagcctgacata

SEQ ID NO: 1870 - DNA, 20 bp, Artificial
  20-mer unique DNA sequence
tcgtgctcacacggtcgatg

SEQ ID NO: 1871 - DNA, 20 bp, Artificial
  20-mer unique DNA sequence
tgactggggtggcgaggaga

SEQ ID NO: 1872 - DNA, 20 bp, Artificial
  20-mer unique DNA sequence
agcgagcgcaaggcttagga

SEQ ID NO: 1873 - DNA, 20 bp, Artificial
  20-mer unique DNA sequence
agagccgcgtagataccgct

SEQ ID NO: 1874 - DNA, 20 bp, Artificial
  20-mer unique DNA sequence
tccacggcactctctcgcat

SEQ ID NO: 1875 - DNA, 20 bp, Artificial
  20-mer unique DNA sequence
gcgactcacggaaaccccca

SEQ ID NO: 1876 - DNA, 20 bp, Artificial
  20-mer unique DNA sequence
tgacatcgctcagtcgggag

SEQ ID NO: 1877 - DNA, 20 bp, Artificial
  20-mer unique DNA sequence
tgcgaacaggtctccacgtc

SEQ ID NO: 1878 - DNA, 20 bp, Artificial
  20-mer unique DNA sequence
ccaaccgattttccaccgct

SEQ ID NO: 1879 - DNA, 20 bp, Artificial
  20-mer unique DNA sequence
tgggggatttgaggcatgga

SEQ ID NO: 1880 - DNA, 20 bp, Artificial
  20-mer unique DNA sequence
tgtgccctcccgttgccttc

SEQ ID NO: 1881 - DNA, 20 bp, Artificial
  20-mer unique DNA sequence
acatagcccaccgccaccag

SEQ ID NO: 1882 - DNA, 20 bp, Artificial
  20-mer unique DNA sequence
aggtcgacccgcgtaaaggt

SEQ ID NO: 1883 - DNA, 20 bp, Artificial
  20-mer unique DNA sequence
ttccgctcggacggattctg

SEQ ID NO: 1884 - DNA, 20 bp, Artificial
  20-mer unique DNA sequence
ggggggtagggtcaacaggg

SEQ ID NO: 1885 - DNA, 20 bp, Artificial
  20-mer unique DNA sequence
caaacgggacgccacaatca

SEQ ID NO: 1886 - DNA, 20 bp, Artificial
  20-mer unique DNA sequence
attccgccgctcccagtcag

SEQ ID NO: 1887 - DNA, 20 bp, Artificial
  20-mer unique DNA sequence
cctcccccagccgtcctttt

SEQ ID NO: 1888 - DNA, 20 bp, Artificial
  20-mer unique DNA sequence
cggttatagtcgacgggcca

SEQ ID NO: 1889 - DNA, 20 bp, Artificial
  20-mer unique DNA sequence
acacggctcgcgcatattga

SEQ ID NO: 1890 - DNA, 20 bp, Artificial
  20-mer unique DNA sequence
gaggtgggcgacagggtagg

SEQ ID NO: 1891 - DNA, 20 bp, Artificial
  20-mer unique DNA sequence
gcagggggacttggtcggtc

SEQ ID NO: 1892 - DNA, 20 bp, Artificial
  20-mer unique DNA sequence
cgagtggaacgggtgacgct

SEQ ID NO: 1893 - DNA, 20 bp, Artificial
  20-mer unique DNA sequence
tgccgttagcggtctacgga

SEQ ID NO: 1894 - DNA, 20 bp, Artificial
  20-mer unique DNA sequence
cgacgggacctaaatgcgca

SEQ ID NO: 1895 - DNA, 20 bp, Artificial
  20-mer unique DNA sequence
accgccagcaacgaataccc

SEQ ID NO: 1896 - DNA, 20 bp, Artificial
  20-mer unique DNA sequence
cgactcccgaggcataaggg

SEQ ID NO: 1897 - DNA, 20 bp, Artificial
  20-mer unique DNA sequence
acgcagccagttgccccaag

SEQ ID NO: 1898 - DNA, 20 bp, Artificial
  20-mer unique DNA sequence
atggggggcgtggttatcga

SEQ ID NO: 1899 - DNA, 20 bp, Artificial
  20-mer unique DNA sequence
gcccgcctgtctttgccaca

SEQ ID NO: 1900 - DNA, 20 bp, Artificial
  20-mer unique DNA sequence
tcgctaacctcaacgcacga

SEQ ID NO: 1901 - DNA, 20 bp, Artificial
  20-mer unique DNA sequence
acaccaccccaacagcgaag

SEQ ID NO: 1902 - DNA, 20 bp, Artificial
  20-mer unique DNA sequence
tgtccccaccgctaaccacc

SEQ ID NO: 1903 - DNA, 20 bp, Artificial
  20-mer unique DNA sequence
taccccccgcactcctacgc

SEQ ID NO: 1904 - DNA, 20 bp, Artificial
  20-mer unique DNA sequence
ttgagagctgtggtgggggc

SEQ ID NO: 1905 - DNA, 20 bp, Artificial
  20-mer unique DNA sequence
tgcatgtccaaaccctcccg

SEQ ID NO: 1906 - DNA, 20 bp, Artificial
  20-mer unique DNA sequence
cctcgcccactcaccaccag

SEQ ID NO: 1907 - DNA, 20 bp, Artificial
  20-mer unique DNA sequence
cattgcctttgacttcgccg

SEQ ID NO: 1908 - DNA, 20 bp, Artificial
  20-mer unique DNA sequence
tactgcacccccattgccgg

SEQ ID NO: 1909 - DNA, 20 bp, Artificial
  20-mer unique DNA sequence
gcccccagctaatccgaatg

SEQ ID NO: 1910 - DNA, 20 bp, Artificial
  20-mer unique DNA sequence
tcgttctggttggcgtgctg

SEQ ID NO: 1911 - DNA, 20 bp, Artificial
  20-mer unique DNA sequence
caccctcactcacgccccca

SEQ ID NO: 1912 - DNA, 20 bp, Artificial
  20-mer unique DNA sequence
tgcttgcggggttttgctcg

SEQ ID NO: 1913 - DNA, 20 bp, Artificial
  20-mer unique DNA sequence
ggccagacaagacccaacgc

SEQ ID NO: 1914 - DNA, 20 bp, Artificial
  20-mer unique DNA sequence
tcgccagttctcgcccacaa

SEQ ID NO: 1915 - DNA, 20 bp, Artificial
  20-mer unique DNA sequence
gattggggtccgacgggctt

SEQ ID NO: 1916 - DNA, 20 bp, Artificial
  20-mer unique DNA sequence
aggggcgggtgtctgcaaaa

SEQ ID NO: 1917 - DNA, 20 bp, Artificial
  20-mer unique DNA sequence
ggatgggcaggatgagctcg

SEQ ID NO: 1918 - DNA, 20 bp, Artificial
  20-mer unique DNA sequence
aaccgccaatccccagcttt

SEQ ID NO: 1919 - DNA, 20 bp, Artificial
  20-mer unique DNA sequence
ggacattgcggggggacctc

SEQ ID NO: 1920 - DNA, 20 bp, Artificial
  20-mer unique DNA sequence
ccggggttactgcgtgggac

SEQ ID NO: 1921 - DNA, 20 bp, Artificial
  20-mer unique DNA sequence
gcacgcctaacgcaaccggt

SEQ ID NO: 1922 - DNA, 20 bp, Artificial
  20-mer unique DNA sequence
tggttgagttgggcgtcgga

SEQ ID NO: 1923 - DNA, 20 bp, Artificial
  20-mer unique DNA sequence
cgcggtcgtgaagtatggcc

SEQ ID NO: 1924 - DNA, 20 bp, Artificial
  20-mer unique DNA sequence
tgccttccctcacccatccg

SEQ ID NO: 1925 - DNA, 20 bp, Artificial
  20-mer unique DNA sequence
cccccccaattcgtctgtcg

SEQ ID NO: 1926 - DNA, 20 bp, Artificial
  20-mer unique DNA sequence
tggggcaacgcaaaagcact

SEQ ID NO: 1927 - DNA, 20 bp, Artificial
  20-mer unique DNA sequence
gggccaaggtgaaagggcat

SEQ ID NO: 1928 - DNA, 20 bp, Artificial
  20-mer unique DNA sequence
ttcggtgcgcccttattcgg

SEQ ID NO: 1929 - DNA, 20 bp, Artificial
  20-mer unique DNA sequence
ctgatcccgctccaccctcg

SEQ ID NO: 1930 - DNA, 20 bp, Artificial
  20-mer unique DNA sequence
gacggggtggcaagggcata

SEQ ID NO: 1931 - DNA, 20 bp, Artificial
  20-mer unique DNA sequence
gtgatagggcggcgagaagg

SEQ ID NO: 1932 - DNA, 20 bp, Artificial
  20-mer unique DNA sequence
gcccgattttcccactgctg

SEQ ID NO: 1933 - DNA, 20 bp, Artificial
  20-mer unique DNA sequence
gaccaaaaacgacggcgcac

SEQ ID NO: 1934 - DNA, 20 bp, Artificial
  20-mer unique DNA sequence
ttgaccattagcccggagcg

SEQ ID NO: 1935 - DNA, 20 bp, Artificial
  20-mer unique DNA sequence
tcgtcgcagtcagttggggg

SEQ ID NO: 1936 - DNA, 20 bp, Artificial
  20-mer unique DNA sequence
tgacgtttcggcgccttctc

SEQ ID NO: 1937 - DNA, 20 bp, Artificial
  20-mer unique DNA sequence
gctttggccgcgtttgttgg

SEQ ID NO: 1938 - DNA, 20 bp, Artificial
  20-mer unique DNA sequence
gcatcaacacggcccccaac

SEQ ID NO: 1939 - DNA, 20 bp, Artificial
  20-mer unique DNA sequence
cgcgcccattgataccgtgt

SEQ ID NO: 1940 - DNA, 20 bp, Artificial
  20-mer unique DNA sequence
gggtggttggactgggcgat

SEQ ID NO: 1941 - DNA, 20 bp, Artificial
  20-mer unique DNA sequence
tgcttgctgggtggtttgat

SEQ ID NO: 1942 - DNA, 20 bp, Artificial
  20-mer unique DNA sequence
cgttatatgccccggcgaga

SEQ ID NO: 1943 - DNA, 20 bp, Artificial
  20-mer unique DNA sequence
tagcgctgagcccagtaggt

SEQ ID NO: 1944 - DNA, 20 bp, Artificial
  20-mer unique DNA sequence
aacggtccgggcccctaata

SEQ ID NO: 1945 - DNA, 20 bp, Artificial
  20-mer unique DNA sequence
tagtgcgcgacctctggact

SEQ ID NO: 1946 - DNA, 20 bp, Artificial
  20-mer unique DNA sequence
atcggcgcgctacgacagat

SEQ ID NO: 1947 - DNA, 20 bp, Artificial
  20-mer unique DNA sequence
tcgctccgcgaaagtaccga

SEQ ID NO: 1948 - DNA, 20 bp, Artificial
  20-mer unique DNA sequence
gcccccgccgttttgtagag

SEQ ID NO: 1949 - DNA, 20 bp, Artificial
  20-mer unique DNA sequence
atcgtaccgcaacccccgtg

SEQ ID NO: 1950 - DNA, 20 bp, Artificial
  20-mer unique DNA sequence
aggcggacggagcagggatg

SEQ ID NO: 1951 - DNA, 20 bp, Artificial
  20-mer unique DNA sequence
actaagcccgttccccgcca

SEQ ID NO: 1952 - DNA, 20 bp, Artificial
  20-mer unique DNA sequence
ttgaccatcgcctcgccttc

SEQ ID NO: 1953 - DNA, 20 bp, Artificial
  20-mer unique DNA sequence
acctcccccaacagaccgct

SEQ ID NO: 1954 - DNA, 20 bp, Artificial
  20-mer unique DNA sequence
tcgaaaagctaccgggcacg

SEQ ID NO: 1955 - DNA, 20 bp, Artificial
  20-mer unique DNA sequence
gtggtcgccccgtctttcag

SEQ ID NO: 1956 - DNA, 20 bp, Artificial
  20-mer unique DNA sequence
cctaacgggttcgctgtcca

SEQ ID NO: 1957 - DNA, 20 bp, Artificial
  20-mer unique DNA sequence
agatgagcgatgaggcccga

SEQ ID NO: 1958 - DNA, 20 bp, Artificial
  20-mer unique DNA sequence
ttgccggttggggtagcttg

SEQ ID NO: 1959 - DNA, 20 bp, Artificial
  20-mer unique DNA sequence
acaccccgaaccgcgctact

SEQ ID NO: 1960 - DNA, 20 bp, Artificial
  20-mer unique DNA sequence
atcgcccgctccaggctaac

SEQ ID NO: 1961 - DNA, 20 bp, Artificial
  20-mer unique DNA sequence
taagtgcgcgtgctgggcag

SEQ ID NO: 1962 - DNA, 20 bp, Artificial
  20-mer unique DNA sequence
gctttcgagtcatggcgcgc

SEQ ID NO: 1963 - DNA, 20 bp, Artificial
  20-mer unique DNA sequence
cgtctcgcgctcccttctcg

SEQ ID NO: 1964 - DNA, 20 bp, Artificial
  20-mer unique DNA sequence
tgtgcgtggtgtggagtgcg

SEQ ID NO: 1965 - DNA, 20 bp, Artificial
  20-mer unique DNA sequence
tgctagtgttgggtccgccg

SEQ ID NO: 1966 - DNA, 20 bp, Artificial
  20-mer unique DNA sequence
gctggatccccggactgttg

SEQ ID NO: 1967 - DNA, 20 bp, Artificial
  20-mer unique DNA sequence
tattagcttggcgccggtgg

SEQ ID NO: 1968 - DNA, 20 bp, Artificial
  20-mer unique DNA sequence
cggactggcggaactgaggg

SEQ ID NO: 1969 - DNA, 20 bp, Artificial
  20-mer unique DNA sequence
aaaggtgggcgttggtctcg

SEQ ID NO: 1970 - DNA, 20 bp, Artificial
  20-mer unique DNA sequence
taatacggctcccgccacca

SEQ ID NO: 1971 - DNA, 20 bp, Artificial
  20-mer unique DNA sequence
cgacccacttttatcgcccg

SEQ ID NO: 1972 - DNA, 20 bp, Artificial
  20-mer unique DNA sequence
gatcttgggggacgctccgg

SEQ ID NO: 1973 - DNA, 20 bp, Artificial
  20-mer unique DNA sequence
ccatgggggagcgcaagaac

SEQ ID NO: 1974 - DNA, 20 bp, Artificial
  20-mer unique DNA sequence
cccttgctaatgcccgttcg

SEQ ID NO: 1975 - DNA, 20 bp, Artificial
  20-mer unique DNA sequence
agccgcccgtcataccatca

SEQ ID NO: 1976 - DNA, 20 bp, Artificial
  20-mer unique DNA sequence
ccagcagcaacccagacccc

SEQ ID NO: 1977 - DNA, 20 bp, Artificial
  20-mer unique DNA sequence
tcattacccggaccgagcgt

SEQ ID NO: 1978 - DNA, 20 bp, Artificial
  20-mer unique DNA sequence
gactaaccgtcggggctcat

SEQ ID NO: 1979 - DNA, 20 bp, Artificial
  20-mer unique DNA sequence
tcgttagcgcggcacctatg

SEQ ID NO: 1980 - DNA, 20 bp, Artificial
  20-mer unique DNA sequence
gcttggttagtggacgcccg

SEQ ID NO: 1981 - DNA, 20 bp, Artificial
  20-mer unique DNA sequence
caggaaacattacgccgccc

SEQ ID NO: 1982 - DNA, 20 bp, Artificial
  20-mer unique DNA sequence
tggtttcaggacatggcgga

SEQ ID NO: 1983 - DNA, 20 bp, Artificial
  20-mer unique DNA sequence
agggggattgtcgaagcggg

SEQ ID NO: 1984 - DNA, 20 bp, Artificial
  20-mer unique DNA sequence
ctaggcggcacgggttcaaa

SEQ ID NO: 1985 - DNA, 20 bp, Artificial
  20-mer unique DNA sequence
cgcgccggcatattacgttt

SEQ ID NO: 1986 - DNA, 20 bp, Artificial
  20-mer unique DNA sequence
agcacaggccgcgattatga

SEQ ID NO: 1987 - DNA, 20 bp, Artificial
  20-mer unique DNA sequence
acccgggacgaagtcaagca

SEQ ID NO: 1988 - DNA, 20 bp, Artificial
  20-mer unique DNA sequence
ttccctcaagacccgcctgc

SEQ ID NO: 1989 - DNA, 20 bp, Artificial
  20-mer unique DNA sequence
aaaagtggagggggcagggg

SEQ ID NO: 1990 - DNA, 20 bp, Artificial
  20-mer unique DNA sequence
tgtttggggccggactttga

SEQ ID NO: 1991 - DNA, 20 bp, Artificial
  20-mer unique DNA sequence
gcaggcgatggacgagcagt

SEQ ID NO: 1992 - DNA, 20 bp, Artificial
  20-mer unique DNA sequence
aacgttagccgtgggcccct

SEQ ID NO: 1993 - DNA, 20 bp, Artificial
  20-mer unique DNA sequence
gtgtgcgctttgagacgggc

SEQ ID NO: 1994 - DNA, 20 bp, Artificial
  20-mer unique DNA sequence
cccctcacccacaggaccca

SEQ ID NO: 1995 - DNA, 20 bp, Artificial
  20-mer unique DNA sequence
tcgcagcccgccctttagtg

SEQ ID NO: 1996 - DNA, 20 bp, Artificial
  20-mer unique DNA sequence
ctacgcacgtgcacaatcgc

SEQ ID NO: 1997 - DNA, 20 bp, Artificial
  20-mer unique DNA sequence
acgggccgtatagagtgtgc

SEQ ID NO: 1998 - DNA, 20 bp, Artificial
  20-mer unique DNA sequence
cctcaatccgccacaagccc

SEQ ID NO: 1999 - DNA, 20 bp, Artificial
  20-mer unique DNA sequence
agggctggcgtgaggcttga

SEQ ID NO: 2000 - DNA, 20 bp, Artificial
  20-mer unique DNA sequence
ttgcgggatgcttcgagcac

SEQ ID NO: 2001 - DNA, 20 bp, Artificial
  20-mer unique DNA sequence
atctccgctagactcgccct

SEQ ID NO: 2002 - DNA, 20 bp, Artificial
  20-mer unique DNA sequence
tgcatgacaccataccgccg

SEQ ID NO: 2003 - DNA, 20 bp, Artificial
  20-mer unique DNA sequence
cgctaggccatttcggcatc

SEQ ID NO: 2004 - DNA, 20 bp, Artificial
  20-mer unique DNA sequence
ccacgggttttacggcaagc

SEQ ID NO: 2005 - DNA, 20 bp, Artificial
  20-mer unique DNA sequence
tatgccactatgccggccag

SEQ ID NO: 2006 - DNA, 20 bp, Artificial
  20-mer unique DNA sequence
cagagtgggtggctaggggc

SEQ ID NO: 2007 - DNA, 20 bp, Artificial
  20-mer unique DNA sequence
tcttcgcgccacctctcgta

SEQ ID NO: 2008 - DNA, 20 bp, Artificial
  20-mer unique DNA sequence
gggtttcacggttctgggcc

SEQ ID NO: 2009 - DNA, 20 bp, Artificial
  20-mer unique DNA sequence
atgatcgaggccgcggctaa

SEQ ID NO: 2010 - DNA, 20 bp, Artificial
  20-mer unique DNA sequence
caaatcctcccgcgtgacca

SEQ ID NO: 2011 - DNA, 20 bp, Artificial
  20-mer unique DNA sequence
gttcctcctttgcgcggttg

SEQ ID NO: 2012 - DNA, 20 bp, Artificial
  20-mer unique DNA sequence
cagccgtcgcacgctaaatg

SEQ ID NO: 2013 - DNA, 20 bp, Artificial
  20-mer unique DNA sequence
tcgtgccacgtgtgtgcttt

SEQ ID NO: 2014 - DNA, 20 bp, Artificial
  20-mer unique DNA sequence
aggacgggatgcggagagag

SEQ ID NO: 2015 - DNA, 20 bp, Artificial
  20-mer unique DNA sequence
ttgatgctggttgcttggcg

SEQ ID NO: 2016 - DNA, 20 bp, Artificial
  20-mer unique DNA sequence
gggtggactggacaggcgag

SEQ ID NO: 2017 - DNA, 20 bp, Artificial
  20-mer unique DNA sequence
acccggacacccaaaacctg

SEQ ID NO: 2018 - DNA, 20 bp, Artificial
  20-mer unique DNA sequence
cttggggccttccgtgttgg

SEQ ID NO: 2019 - DNA, 20 bp, Artificial
  20-mer unique DNA sequence
gagggcgcacggttcaggtt

SEQ ID NO: 2020 - DNA, 20 bp, Artificial
  20-mer unique DNA sequence
tccgtgccgcgtttattgtg

SEQ ID NO: 2021 - DNA, 20 bp, Artificial
  20-mer unique DNA sequence
gcgcgggatgtggtagagct

SEQ ID NO: 2022 - DNA, 20 bp, Artificial
  20-mer unique DNA sequence
atatgggtgcctggggctca

SEQ ID NO: 2023 - DNA, 20 bp, Artificial
  20-mer unique DNA sequence
acacacaccaagccgggagg

SEQ ID NO: 2024 - DNA, 20 bp, Artificial
  20-mer unique DNA sequence
cgggcggtggcgagtatgac

SEQ ID NO: 2025 - DNA, 20 bp, Artificial
  20-mer unique DNA sequence
attcacccgcatgtccgtcg

SEQ ID NO: 2026 - DNA, 20 bp, Artificial
  20-mer unique DNA sequence
gccgacctatcccgtccacc

SEQ ID NO: 2027 - DNA, 20 bp, Artificial
  20-mer unique DNA sequence
gcccaatgagcgaaccctgc

SEQ ID NO: 2028 - DNA, 20 bp, Artificial
  20-mer unique DNA sequence
tcgttcccaccgccctatct

SEQ ID NO: 2029 - DNA, 20 bp, Artificial
  20-mer unique DNA sequence
gggcataggacggcgggatt

SEQ ID NO: 2030 - DNA, 20 bp, Artificial
  20-mer unique DNA sequence
gcggtctggagttgggtggt

SEQ ID NO: 2031 - DNA, 20 bp, Artificial
  20-mer unique DNA sequence
agtgacagagggggccagga

SEQ ID NO: 2032 - DNA, 20 bp, Artificial
  20-mer unique DNA sequence
gcacggaccagtcgtgagat

SEQ ID NO: 2033 - DNA, 20 bp, Artificial
  20-mer unique DNA sequence
cgggcgtacaaagggcaaag

SEQ ID NO: 2034 - DNA, 20 bp, Artificial
  20-mer unique DNA sequence
agcaccccgccaaatcaaac

SEQ ID NO: 2035 - DNA, 20 bp, Artificial
  20-mer unique DNA sequence
aggggctcggttttaggagg

SEQ ID NO: 2036 - DNA, 20 bp, Artificial
  20-mer unique DNA sequence
tgtcgacgcatcgtgggagt

SEQ ID NO: 2037 - DNA, 20 bp, Artificial
  20-mer unique DNA sequence
cgggaagctgcaagatgcgg

SEQ ID NO: 2038 - DNA, 20 bp, Artificial
  20-mer unique DNA sequence
ttcagtccaacgcgccatcg

SEQ ID NO: 2039 - DNA, 20 bp, Artificial
  20-mer unique DNA sequence
gcggggggacgtagcaacac

SEQ ID NO: 2040 - DNA, 20 bp, Artificial
  20-mer unique DNA sequence
cccgtgtttcctcgagcctg

SEQ ID NO: 2041 - DNA, 20 bp, Artificial
  20-mer unique DNA sequence
tccgcgactgcctcctccaa

SEQ ID NO: 2042 - DNA, 20 bp, Artificial
  20-mer unique DNA sequence
cagagacaacgcccaacccc

SEQ ID NO: 2043 - DNA, 20 bp, Artificial
  20-mer unique DNA sequence
cgacaccggaggccaaatga

SEQ ID NO: 2044 - DNA, 20 bp, Artificial
  20-mer unique DNA sequence
gggtgtcaagggtgatggcg

SEQ ID NO: 2045 - DNA, 20 bp, Artificial
  20-mer unique DNA sequence
cgctgctttccgccttcacg

SEQ ID NO: 2046 - DNA, 20 bp, Artificial
  20-mer unique DNA sequence
cctcctagcgaaccggcgga

SEQ ID NO: 2047 - DNA, 20 bp, Artificial
  20-mer unique DNA sequence
gtctctcctcccatcgcccg

SEQ ID NO: 2048 - DNA, 20 bp, Artificial
  20-mer unique DNA sequence
aacacgcagtcagcggccag

SEQ ID NO: 2049 - DNA, 20 bp, Artificial
  20-mer unique DNA sequence
gcttgcgtgcgtgagagtgg

SEQ ID NO: 2050 - DNA, 20 bp, Artificial
  20-mer unique DNA sequence
tcgccttggaaccttggggc

SEQ ID NO: 2051 - DNA, 20 bp, Artificial
  20-mer unique DNA sequence
ttgtcttccccgagcttggc

SEQ ID NO: 2052 - DNA, 20 bp, Artificial
  20-mer unique DNA sequence
accaaaagcccccagcgagt

SEQ ID NO: 2053 - DNA, 20 bp, Artificial
  20-mer unique DNA sequence
agcccccccctgaagaagtg

SEQ ID NO: 2054 - DNA, 20 bp, Artificial
  20-mer unique DNA sequence
ccgttcgtccctgccacctc

SEQ ID NO: 2055 - DNA, 20 bp, Artificial
  20-mer unique DNA sequence
tggcgtgcgtgctgtgttcc

SEQ ID NO: 2056 - DNA, 20 bp, Artificial
  20-mer unique DNA sequence
tcaccctcctccgcctcgat

SEQ ID NO: 2057 - DNA, 20 bp, Artificial
  20-mer unique DNA sequence
gagtgggggcggagaagcag

SEQ ID NO: 2058 - DNA, 20 bp, Artificial
  20-mer unique DNA sequence
acacgaccttgccccagtgc

SEQ ID NO: 2059 - DNA, 20 bp, Artificial
  20-mer unique DNA sequence
accacgctagcccgtcaacg

SEQ ID NO: 2060 - DNA, 20 bp, Artificial
  20-mer unique DNA sequence
cttttgagtcttgggcgcgg

SEQ ID NO: 2061 - DNA, 20 bp, Artificial
  20-mer unique DNA sequence
ctcgttggcggctgtttcgg

SEQ ID NO: 2062 - DNA, 20 bp, Artificial
  20-mer unique DNA sequence
ttgggctgggacgttgccta

SEQ ID NO: 2063 - DNA, 20 bp, Artificial
  20-mer unique DNA sequence
aggcctcattgcgcaaccag

SEQ ID NO: 2064 - DNA, 20 bp, Artificial
  20-mer unique DNA sequence
tattccgtcgcgctgtgatc

SEQ ID NO: 2065 - DNA, 20 bp, Artificial
  20-mer unique DNA sequence
ccccgtcgatgctgttgcta

SEQ ID NO: 2066 - DNA, 20 bp, Artificial
  20-mer unique DNA sequence
gcattcacggcggctttgga

SEQ ID NO: 2067 - DNA, 20 bp, Artificial
  20-mer unique DNA sequence
ctgattttggttgtgcgcgg

SEQ ID NO: 2068 - DNA, 20 bp, Artificial
  20-mer unique DNA sequence
tgcggatgcgaaaagaaggc

SEQ ID NO: 2069 - DNA, 20 bp, Artificial
  20-mer unique DNA sequence
tgccttttagcctcccgccc

SEQ ID NO: 2070 - DNA, 20 bp, Artificial
  20-mer unique DNA sequence
caaaaatcaatgccgcgcga

SEQ ID NO: 2071 - DNA, 20 bp, Artificial
  20-mer unique DNA sequence
ccgtggcgagctttgatcag

SEQ ID NO: 2072 - DNA, 20 bp, Artificial
  20-mer unique DNA sequence
gaactgggggagcgaggtga

SEQ ID NO: 2073 - DNA, 20 bp, Artificial
  20-mer unique DNA sequence
gaaacgggggctaaactgcg

SEQ ID NO: 2074 - DNA, 20 bp, Artificial
  20-mer unique DNA sequence
tccctcacagccgcctcaac

SEQ ID NO: 2075 - DNA, 20 bp, Artificial
  20-mer unique DNA sequence
cccctcgtctttgcagctcg

SEQ ID NO: 2076 - DNA, 20 bp, Artificial
  20-mer unique DNA sequence
cgcccccctcagcacgaatt

SEQ ID NO: 2077 - DNA, 20 bp, Artificial
  20-mer unique DNA sequence
agggcgcgtggacaagggat

SEQ ID NO: 2078 - DNA, 20 bp, Artificial
  20-mer unique DNA sequence
cgtgtttagcggcgggcatc

SEQ ID NO: 2079 - DNA, 20 bp, Artificial
  20-mer unique DNA sequence
gatgcggcccccaaagaatt

SEQ ID NO: 2080 - DNA, 20 bp, Artificial
  20-mer unique DNA sequence
ggctcccccatgctacgtga

SEQ ID NO: 2081 - DNA, 20 bp, Artificial
  20-mer unique DNA sequence
gatcccaccgcgctccctgt

SEQ ID NO: 2082 - DNA, 20 bp, Artificial
  20-mer unique DNA sequence
aaacctgtggcgacacgcga

SEQ ID NO: 2083 - DNA, 20 bp, Artificial
  20-mer unique DNA sequence
atgctgacaatcggctgccc

SEQ ID NO: 2084 - DNA, 20 bp, Artificial
  20-mer unique DNA sequence
aaaaggcgcgagggtcaagg

SEQ ID NO: 2085 - DNA, 20 bp, Artificial
  20-mer unique DNA sequence
cagcgtaagacggcacctgt

SEQ ID NO: 2086 - DNA, 20 bp, Artificial
  20-mer unique DNA sequence
aagggtgggcagacgcgaac

SEQ ID NO: 2087 - DNA, 20 bp, Artificial
  20-mer unique DNA sequence
accggccttgcttgacgttt

SEQ ID NO: 2088 - DNA, 20 bp, Artificial
  20-mer unique DNA sequence
tttcattgcggtcagcggtc

SEQ ID NO: 2089 - DNA, 20 bp, Artificial
  20-mer unique DNA sequence
tgttactgggggagggcttg

SEQ ID NO: 2090 - DNA, 20 bp, Artificial
  20-mer unique DNA sequence
tggccgctcccaacctacag

SEQ ID NO: 2091 - DNA, 20 bp, Artificial
  20-mer unique DNA sequence
tcgtcagcgcctaacagggg

SEQ ID NO: 2092 - DNA, 20 bp, Artificial
  20-mer unique DNA sequence
cctctttctggccgaccccg

SEQ ID NO: 2093 - DNA, 20 bp, Artificial
  20-mer unique DNA sequence
attcgtatctgccgcgcccc

SEQ ID NO: 2094 - DNA, 20 bp, Artificial
  20-mer unique DNA sequence
tgcgccgcttcacgaaataa

SEQ ID NO: 2095 - DNA, 20 bp, Artificial
  20-mer unique DNA sequence
gtcttcacccccccaccgag

SEQ ID NO: 2096 - DNA, 20 bp, Artificial
  20-mer unique DNA sequence
tctgtaggccgcggatggac

SEQ ID NO: 2097 - DNA, 20 bp, Artificial
  20-mer unique DNA sequence
cagcccgcctcctccttcac

SEQ ID NO: 2098 - DNA, 20 bp, Artificial
  20-mer unique DNA sequence
aaatggcaggcaagtcggct

SEQ ID NO: 2099 - DNA, 20 bp, Artificial
  20-mer unique DNA sequence
cttttccatgagtcccccgc

SEQ ID NO: 2100 - DNA, 20 bp, Artificial
  20-mer unique DNA sequence
cgacagaaacccgcagccct

SEQ ID NO: 2101 - DNA, 20 bp, Artificial
  20-mer unique DNA sequence
tttccacttttccgcgcctc

SEQ ID NO: 2102 - DNA, 20 bp, Artificial
  20-mer unique DNA sequence
acggcgctcctctggttgtg

SEQ ID NO: 2103 - DNA, 20 bp, Artificial
  20-mer unique DNA sequence
tttggagggggtcgggagaa

SEQ ID NO: 2104 - DNA, 20 bp, Artificial
  20-mer unique DNA sequence
ggcgatggagggcagaggac

SEQ ID NO: 2105 - DNA, 20 bp, Artificial
  20-mer unique DNA sequence
gggcggttgttggcgagagt

SEQ ID NO: 2106 - DNA, 20 bp, Artificial
  20-mer unique DNA sequence
ggtcttgttggcggattggc

SEQ ID NO: 2107 - DNA, 20 bp, Artificial
  20-mer unique DNA sequence
agttctcccacccccgttgc

SEQ ID NO: 2108 - DNA, 20 bp, Artificial
  20-mer unique DNA sequence
actgtgcggcgatgtaggtc

SEQ ID NO: 2109 - DNA, 20 bp, Artificial
  20-mer unique DNA sequence
catgtgcgaggtctggggaa

SEQ ID NO: 2110 - DNA, 20 bp, Artificial
  20-mer unique DNA sequence
tctctccgccgccaccctct

SEQ ID NO: 2111 - DNA, 20 bp, Artificial
  20-mer unique DNA sequence
tgaggtggcgtttgctgctc

SEQ ID NO: 2112 - DNA, 20 bp, Artificial
  20-mer unique DNA sequence
ctcaacccagccccaaacgg

SEQ ID NO: 2113 - DNA, 20 bp, Artificial
  20-mer unique DNA sequence
cccctacacatgcaacccgc

SEQ ID NO: 2114 - DNA, 20 bp, Artificial
  20-mer unique DNA sequence
cgagccctttctgaccctgc

SEQ ID NO: 2115 - DNA, 20 bp, Artificial
  20-mer unique DNA sequence
tccgaggaatgcataacgcg

SEQ ID NO: 2116 - DNA, 20 bp, Artificial
  20-mer unique DNA sequence
acacttgcccgcccgattaa

SEQ ID NO: 2117 - DNA, 20 bp, Artificial
  20-mer unique DNA sequence
tccttgcttcgggtgcttgg

SEQ ID NO: 2118 - DNA, 20 bp, Artificial
  20-mer unique DNA sequence
ccccttgtgaaacccatgcc

SEQ ID NO: 2119 - DNA, 20 bp, Artificial
  20-mer unique DNA sequence
ccccccttgttcccttcgac

SEQ ID NO: 2120 - DNA, 20 bp, Artificial
  20-mer unique DNA sequence
tcggtgtaatgtaggcgcgg

SEQ ID NO: 2121 - DNA, 20 bp, Artificial
  20-mer unique DNA sequence
ggatttcgcggggaggctta

SEQ ID NO: 2122 - DNA, 20 bp, Artificial
  20-mer unique DNA sequence
tagacgggacaagcggcgaa

SEQ ID NO: 2123 - DNA, 20 bp, Artificial
  20-mer unique DNA sequence
gttcgtgcgggttgggagtc

SEQ ID NO: 2124 - DNA, 20 bp, Artificial
  20-mer unique DNA sequence
gtgggtagctccgaacagca

SEQ ID NO: 2125 - DNA, 20 bp, Artificial
  20-mer unique DNA sequence
agggtgactgacccgagcaa

SEQ ID NO: 2126 - DNA, 20 bp, Artificial
  20-mer unique DNA sequence
gggcggccaacatctcgtgt

SEQ ID NO: 2127 - DNA, 20 bp, Artificial
  20-mer unique DNA sequence
ctttcgctttagtcccgcgg

SEQ ID NO: 2128 - DNA, 20 bp, Artificial
  20-mer unique DNA sequence
gagggcaaaacgaccgccta

SEQ ID NO: 2129 - DNA, 20 bp, Artificial
  20-mer unique DNA sequence
aacatcaccgcctccgcaaa

SEQ ID NO: 2130 - DNA, 20 bp, Artificial
  20-mer unique DNA sequence
cactttgtacccgccacgcc

SEQ ID NO: 2131 - DNA, 20 bp, Artificial
  20-mer unique DNA sequence
ccgcgtcccatcgtttgttg

SEQ ID NO: 2132 - DNA, 20 bp, Artificial
  20-mer unique DNA sequence
attaactgggcgggatcggc

SEQ ID NO: 2133 - DNA, 20 bp, Artificial
  20-mer unique DNA sequence
gaggacggcgaacgaaagcg

SEQ ID NO: 2134 - DNA, 20 bp, Artificial
  20-mer unique DNA sequence
gaccgcattcgccccttttt

SEQ ID NO: 2135 - DNA, 20 bp, Artificial
  20-mer unique DNA sequence
tctggggtcaaggcggaagt

SEQ ID NO: 2136 - DNA, 20 bp, Artificial
  20-mer unique DNA sequence
caccccccctctttttccgc

SEQ ID NO: 2137 - DNA, 20 bp, Artificial
  20-mer unique DNA sequence
ggaggtcggggtttgtgtgc

SEQ ID NO: 2138 - DNA, 20 bp, Artificial
  20-mer unique DNA sequence
gcaaccgcggctcctactgt

SEQ ID NO: 2139 - DNA, 20 bp, Artificial
  20-mer unique DNA sequence
agcagccaacaccgccaaag

SEQ ID NO: 2140 - DNA, 20 bp, Artificial
  20-mer unique DNA sequence
ttcgtgtcctcgcgttgcaa

SEQ ID NO: 2141 - DNA, 20 bp, Artificial
  20-mer unique DNA sequence
gaagcgtaaggccggcagac

SEQ ID NO: 2142 - DNA, 20 bp, Artificial
  20-mer unique DNA sequence
cccaattatccacgggggca

SEQ ID NO: 2143 - DNA, 20 bp, Artificial
  20-mer unique DNA sequence
ctgttggggtcgtctgccgg

SEQ ID NO: 2144 - DNA, 20 bp, Artificial
  20-mer unique DNA sequence
tggatgcgtgggggatgaac

SEQ ID NO: 2145 - DNA, 20 bp, Artificial
  20-mer unique DNA sequence
ttcgtcccttggctcttccg

SEQ ID NO: 2146 - DNA, 20 bp, Artificial
  20-mer unique DNA sequence
accaccacgagcacagacgc

SEQ ID NO: 2147 - DNA, 20 bp, Artificial
  20-mer unique DNA sequence
gaagggaaaccgcaagccac

SEQ ID NO: 2148 - DNA, 20 bp, Artificial
  20-mer unique DNA sequence
gagccgcgccgaatgaagat

SEQ ID NO: 2149 - DNA, 20 bp, Artificial
  20-mer unique DNA sequence
agcccgcacagacccaaaac

SEQ ID NO: 2150 - DNA, 20 bp, Artificial
  20-mer unique DNA sequence
ttctccgcgtcaaatcggtg

SEQ ID NO: 2151 - DNA, 20 bp, Artificial
  20-mer unique DNA sequence
gttcggccgcactacggact

SEQ ID NO: 2152 - DNA, 20 bp, Artificial
  20-mer unique DNA sequence
agtcctggcctgacacttcg

SEQ ID NO: 2153 - DNA, 20 bp, Artificial
  20-mer unique DNA sequence
tgatcttactgcgggccgtt

SEQ ID NO: 2154 - DNA, 20 bp, Artificial
  20-mer unique DNA sequence
aagggcggtttcagtggcag

SEQ ID NO: 2155 - DNA, 20 bp, Artificial
  20-mer unique DNA sequence
cgttcctccacacccagcct

SEQ ID NO: 2156 - DNA, 20 bp, Artificial
  20-mer unique DNA sequence
ttcgtggcggttgtggtttg

SEQ ID NO: 2157 - DNA, 20 bp, Artificial
  20-mer unique DNA sequence
tcccgcattccgtcccattc

SEQ ID NO: 2158 - DNA, 20 bp, Artificial
  20-mer unique DNA sequence
gcacgccccctataccccag

SEQ ID NO: 2159 - DNA, 20 bp, Artificial
  20-mer unique DNA sequence
cggtgggcaaggacatacga

SEQ ID NO: 2160 - DNA, 20 bp, Artificial
  20-mer unique DNA sequence
tggctggcggtattgttgca

SEQ ID NO: 2161 - DNA, 20 bp, Artificial
  20-mer unique DNA sequence
cgaaaaggggggggggtaat

SEQ ID NO: 2162 - DNA, 20 bp, Artificial
  20-mer unique DNA sequence
ccccagccgattagcccgta

SEQ ID NO: 2163 - DNA, 20 bp, Artificial
  20-mer unique DNA sequence
cacttcgcttccctgtcgct

SEQ ID NO: 2164 - DNA, 20 bp, Artificial
  20-mer unique DNA sequence
ttcagatggtgcgcttcccg

SEQ ID NO: 2165 - DNA, 20 bp, Artificial
  20-mer unique DNA sequence
ttaacccacttccagccccg

SEQ ID NO: 2166 - DNA, 20 bp, Artificial
  20-mer unique DNA sequence
caagagcccccgagaccagc

SEQ ID NO: 2167 - DNA, 20 bp, Artificial
  20-mer unique DNA sequence
gtttcatccgcgcactcccg

SEQ ID NO: 2168 - DNA, 20 bp, Artificial
  20-mer unique DNA sequence
ggggtcgggaaaggtctggc

SEQ ID NO: 2169 - DNA, 20 bp, Artificial
  20-mer unique DNA sequence
ccaaccgcactttccgccta

SEQ ID NO: 2170 - DNA, 20 bp, Artificial
  20-mer unique DNA sequence
accaactgccacgaaagtcc

SEQ ID NO: 2171 - DNA, 20 bp, Artificial
  20-mer unique DNA sequence
tacaccctactcccccgcga

SEQ ID NO: 2172 - DNA, 20 bp, Artificial
  20-mer unique DNA sequence
cgtgccctctatgtcccgcc

SEQ ID NO: 2173 - DNA, 20 bp, Artificial
  20-mer unique DNA sequence
ctcctcgggcaacgcgctac

SEQ ID NO: 2174 - DNA, 20 bp, Artificial
  20-mer unique DNA sequence
gacgagattgtggggcgctt

SEQ ID NO: 2175 - DNA, 20 bp, Artificial
  20-mer unique DNA sequence
acaatgcgggtctggcggtc

SEQ ID NO: 2176 - DNA, 20 bp, Artificial
  20-mer unique DNA sequence
tgtcctcctgccgtgttgcc

SEQ ID NO: 2177 - DNA, 20 bp, Artificial
  20-mer unique DNA sequence
tgctgcagtctgacacgtcc

SEQ ID NO: 2178 - DNA, 20 bp, Artificial
  20-mer unique DNA sequence
catcccccaacagacaggcg

SEQ ID NO: 2179 - DNA, 20 bp, Artificial
  20-mer unique DNA sequence
ttcaatggccggagggtttc

SEQ ID NO: 2180 - DNA, 20 bp, Artificial
  20-mer unique DNA sequence
ttttcgccccacattttgca

SEQ ID NO: 2181 - DNA, 20 bp, Artificial
  20-mer unique DNA sequence
cggtctcgcttcgcctatcc

SEQ ID NO: 2182 - DNA, 20 bp, Artificial
  20-mer unique DNA sequence
cgcggggcagaaccttgata

SEQ ID NO: 2183 - DNA, 20 bp, Artificial
  20-mer unique DNA sequence
ggggtcaggggcaacggaat

SEQ ID NO: 2184 - DNA, 20 bp, Artificial
  20-mer unique DNA sequence
aaacagacaaccgccccgtc

SEQ ID NO: 2185 - DNA, 20 bp, Artificial
  20-mer unique DNA sequence
ctaccgacgccaacacccct

SEQ ID NO: 2186 - DNA, 20 bp, Artificial
  20-mer unique DNA sequence
aggggcgaaaaggaatgcgt

SEQ ID NO: 2187 - DNA, 20 bp, Artificial
  20-mer unique DNA sequence
gtacccacaatgccaccgcc

SEQ ID NO: 2188 - DNA, 20 bp, Artificial
  20-mer unique DNA sequence
tctttctccgcacccccagc

SEQ ID NO: 2189 - DNA, 20 bp, Artificial
  20-mer unique DNA sequence
gaaagtcccgtcgccatgct

SEQ ID NO: 2190 - DNA, 20 bp, Artificial
  20-mer unique DNA sequence
tcagaacacccccagaggat

SEQ ID NO: 2191 - DNA, 20 bp, Artificial
  20-mer unique DNA sequence
cctcccttcccatcgtgcca

SEQ ID NO: 2192 - DNA, 20 bp, Artificial
  20-mer unique DNA sequence
ttcggggggctgtagtgacc

SEQ ID NO: 2193 - DNA, 20 bp, Artificial
  20-mer unique DNA sequence
attcgcgttgcactccccat

SEQ ID NO: 2194 - DNA, 20 bp, Artificial
  20-mer unique DNA sequence
gaaggcgacgggagggtcat

SEQ ID NO: 2195 - DNA, 20 bp, Artificial
  20-mer unique DNA sequence
ccgcaaagcactccactcca

SEQ ID NO: 2196 - DNA, 20 bp, Artificial
  20-mer unique DNA sequence
gctcgttagtcaccagcgga

SEQ ID NO: 2197 - DNA, 20 bp, Artificial
  20-mer unique DNA sequence
cacccatcccactccagccg

SEQ ID NO: 2198 - DNA, 20 bp, Artificial
  20-mer unique DNA sequence
ggaaagggtgcgataagcgg

SEQ ID NO: 2199 - DNA, 20 bp, Artificial
  20-mer unique DNA sequence
ccccacattactcgcacccg

SEQ ID NO: 2200 - DNA, 20 bp, Artificial
  20-mer unique DNA sequence
gcgcaggaatacaagggccg

SEQ ID NO: 2201 - DNA, 20 bp, Artificial
  20-mer unique DNA sequence
tcggattggcttagggtggt

SEQ ID NO: 2202 - DNA, 20 bp, Artificial
  20-mer unique DNA sequence
tccgggtaggtcacgagcgt

SEQ ID NO: 2203 - DNA, 20 bp, Artificial
  20-mer unique DNA sequence
cgtgggtcgaaatggccatg

SEQ ID NO: 2204 - DNA, 20 bp, Artificial
  20-mer unique DNA sequence
ctccaagacgcgccaacaga

SEQ ID NO: 2205 - DNA, 20 bp, Artificial
  20-mer unique DNA sequence
atccttcctgcggctacccg

SEQ ID NO: 2206 - DNA, 20 bp, Artificial
  20-mer unique DNA sequence
actgccgcccaatccaagag

SEQ ID NO: 2207 - DNA, 20 bp, Artificial
  20-mer unique DNA sequence
accgccaccgtaaatccgcc

SEQ ID NO: 2208 - DNA, 20 bp, Artificial
  20-mer unique DNA sequence
tcctgctcgccacccctcaa

SEQ ID NO: 2209 - DNA, 20 bp, Artificial
  20-mer unique DNA sequence
acgcggaggggatcttggga

SEQ ID NO: 2210 - DNA, 20 bp, Artificial
  20-mer unique DNA sequence
gtagttggaccctggcggcg

SEQ ID NO: 2211 - DNA, 20 bp, Artificial
  20-mer unique DNA sequence
ggattgcgcttccatgtgcg

SEQ ID NO: 2212 - DNA, 20 bp, Artificial
  20-mer unique DNA sequence
attccgtggacaccccccag

SEQ ID NO: 2213 - DNA, 20 bp, Artificial
  20-mer unique DNA sequence
tcggcgcttggctttttgtt

SEQ ID NO: 2214 - DNA, 20 bp, Artificial
  20-mer unique DNA sequence
tacccacggccggaatgaac

SEQ ID NO: 2215 - DNA, 20 bp, Artificial
  20-mer unique DNA sequence
ggggtattggccagggggtt

SEQ ID NO: 2216 - DNA, 20 bp, Artificial
  20-mer unique DNA sequence
cacgagggaacgggctgagg

SEQ ID NO: 2217 - DNA, 20 bp, Artificial
  20-mer unique DNA sequence
cttgcctcgcgtctgccctt

SEQ ID NO: 2218 - DNA, 20 bp, Artificial
  20-mer unique DNA sequence
cgtgcttgacttgccccgac

SEQ ID NO: 2219 - DNA, 20 bp, Artificial
  20-mer unique DNA sequence
tccctcccggttcagtcgcc

SEQ ID NO: 2220 - DNA, 20 bp, Artificial
  20-mer unique DNA sequence
cggggccatagaacaagcga

SEQ ID NO: 2221 - DNA, 20 bp, Artificial
  20-mer unique DNA sequence
ctttcgcctagcctcgccat

SEQ ID NO: 2222 - DNA, 20 bp, Artificial
  20-mer unique DNA sequence
gttggggagggcgtcgtcgg

SEQ ID NO: 2223 - DNA, 20 bp, Artificial
  20-mer unique DNA sequence
tacctgggatggggggaccg

SEQ ID NO: 2224 - DNA, 20 bp, Artificial
  20-mer unique DNA sequence
atactcccaaccacgcagga

SEQ ID NO: 2225 - DNA, 20 bp, Artificial
  20-mer unique DNA sequence
tgcgggttcaatacgggtgc

SEQ ID NO: 2226 - DNA, 20 bp, Artificial
  20-mer unique DNA sequence
cacatgcatcgaccccaagc

SEQ ID NO: 2227 - DNA, 20 bp, Artificial
  20-mer unique DNA sequence
ctgttctacgccggctcttc

SEQ ID NO: 2228 - DNA, 20 bp, Artificial
  20-mer unique DNA sequence
tcgttggggcgtttgtggac

SEQ ID NO: 2229 - DNA, 20 bp, Artificial
  20-mer unique DNA sequence
acgtggtgggggggtggacg

SEQ ID NO: 2230 - DNA, 20 bp, Artificial
  20-mer unique DNA sequence
gatggcgtggcggaagtacc

SEQ ID NO: 2231 - DNA, 20 bp, Artificial
  20-mer unique DNA sequence
ttgaacacagtggcgcggga

SEQ ID NO: 2232 - DNA, 20 bp, Artificial
  20-mer unique DNA sequence
gcagagctacaggtcgcgta

SEQ ID NO: 2233 - DNA, 20 bp, Artificial
  20-mer unique DNA sequence
gtcgtgacagtgctctcgct

SEQ ID NO: 2234 - DNA, 20 bp, Artificial
  20-mer unique DNA sequence
ctgttcggttggtcacgggt

SEQ ID NO: 2235 - DNA, 20 bp, Artificial
  20-mer unique DNA sequence
cctgctccgtgaagtcccgt

SEQ ID NO: 2236 - DNA, 20 bp, Artificial
  20-mer unique DNA sequence
cgccactcccttgcctcaat

SEQ ID NO: 2237 - DNA, 20 bp, Artificial
  20-mer unique DNA sequence
tgtgccccccgtgtccttag

SEQ ID NO: 2238 - DNA, 20 bp, Artificial
  20-mer unique DNA sequence
tctgatggactggagcgcgc

SEQ ID NO: 2239 - DNA, 20 bp, Artificial
  20-mer unique DNA sequence
ggaccagcaggagcccacaa

SEQ ID NO: 2240 - DNA, 20 bp, Artificial
  20-mer unique DNA sequence
tcttcctggcacgcttgtcg

SEQ ID NO: 2241 - DNA, 20 bp, Artificial
  20-mer unique DNA sequence
tccctccgccgcaatcataa

SEQ ID NO: 2242 - DNA, 20 bp, Artificial
  20-mer unique DNA sequence
agaagaaaagcaccccagcg

SEQ ID NO: 2243 - DNA, 20 bp, Artificial
  20-mer unique DNA sequence
cggttcggcacgtcttctca

SEQ ID NO: 2244 - DNA, 20 bp, Artificial
  20-mer unique DNA sequence
taccgcccccgcattctctg

SEQ ID NO: 2245 - DNA, 20 bp, Artificial
  20-mer unique DNA sequence
tcccccttcgtgagcctttg

SEQ ID NO: 2246 - DNA, 20 bp, Artificial
  20-mer unique DNA sequence
tgcgaattggtggccggtag

SEQ ID NO: 2247 - DNA, 20 bp, Artificial
  20-mer unique DNA sequence
aaatgcttggaggcgtcggg

SEQ ID NO: 2248 - DNA, 20 bp, Artificial
  20-mer unique DNA sequence
aactcccctaatccgcctgc

SEQ ID NO: 2249 - DNA, 20 bp, Artificial
  20-mer unique DNA sequence
cacgacgcccacgacctacg

SEQ ID NO: 2250 - DNA, 20 bp, Artificial
  20-mer unique DNA sequence
tattcgtgccccccgttctc

SEQ ID NO: 2251 - DNA, 20 bp, Artificial
  20-mer unique DNA sequence
ggtagcaatctggggaggcg

SEQ ID NO: 2252 - DNA, 20 bp, Artificial
  20-mer unique DNA sequence
gcacacccaagcgcaagcaa

SEQ ID NO: 2253 - DNA, 20 bp, Artificial
  20-mer unique DNA sequence
aggtcccgcgcagaattcaa

SEQ ID NO: 2254 - DNA, 20 bp, Artificial
  20-mer unique DNA sequence
tctttgcgcgctgaaccctg

SEQ ID NO: 2255 - DNA, 20 bp, Artificial
  20-mer unique DNA sequence
gtcttgcctggagcccctgc

SEQ ID NO: 2256 - DNA, 20 bp, Artificial
  20-mer unique DNA sequence
tgggagggggcacagaccag

SEQ ID NO: 2257 - DNA, 20 bp, Artificial
  20-mer unique DNA sequence
ctcccacagtcatggcccca

SEQ ID NO: 2258 - DNA, 20 bp, Artificial
  20-mer unique DNA sequence
cggcgaggctgagggatttc

SEQ ID NO: 2259 - DNA, 20 bp, Artificial
  20-mer unique DNA sequence
cccggcgcgtcttgatacca

SEQ ID NO: 2260 - DNA, 20 bp, Artificial
  20-mer unique DNA sequence
tgcctgtcgttcgtcgttcc

SEQ ID NO: 2261 - DNA, 20 bp, Artificial
  20-mer unique DNA sequence
tcggaggaatagcaaggcaa

SEQ ID NO: 2262 - DNA, 20 bp, Artificial
  20-mer unique DNA sequence
tatgtgccccttgcctgctg

SEQ ID NO: 2263 - DNA, 20 bp, Artificial
  20-mer unique DNA sequence
aacacggggaaggtagcgga

SEQ ID NO: 2264 - DNA, 20 bp, Artificial
  20-mer unique DNA sequence
atttatctcggcccgccctc

SEQ ID NO: 2265 - DNA, 20 bp, Artificial
  20-mer unique DNA sequence
tgcgaaactaggcgtgagcc

SEQ ID NO: 2266 - DNA, 20 bp, Artificial
  20-mer unique DNA sequence
gccgcaccagccgttatcag

SEQ ID NO: 2267 - DNA, 20 bp, Artificial
  20-mer unique DNA sequence
tagcttgcggatggtgaggc

SEQ ID NO: 2268 - DNA, 20 bp, Artificial
  20-mer unique DNA sequence
taggccaaaaccgcgtgatg

SEQ ID NO: 2269 - DNA, 20 bp, Artificial
  20-mer unique DNA sequence
acgtcaggccgcagcatttt

SEQ ID NO: 2270 - DNA, 20 bp, Artificial
  20-mer unique DNA sequence
cgtcgttcccgatttcccct

SEQ ID NO: 2271 - DNA, 20 bp, Artificial
  20-mer unique DNA sequence
accatcgccgcgccgtttat

SEQ ID NO: 2272 - DNA, 20 bp, Artificial
  20-mer unique DNA sequence
atttgtctcccggcgtgcta

SEQ ID NO: 2273 - DNA, 20 bp, Artificial
  20-mer unique DNA sequence
tatccctgcgtgacgaccct

SEQ ID NO: 2274 - DNA, 20 bp, Artificial
  20-mer unique DNA sequence
tccctacagacccgccccaa

SEQ ID NO: 2275 - DNA, 20 bp, Artificial
  20-mer unique DNA sequence
aaacaaaaccgccagcccga

SEQ ID NO: 2276 - DNA, 20 bp, Artificial
  20-mer unique DNA sequence
ctgccccgtctccttgttgc

SEQ ID NO: 2277 - DNA, 20 bp, Artificial
  20-mer unique DNA sequence
tttacccccaacccctccct

SEQ ID NO: 2278 - DNA, 20 bp, Artificial
  20-mer unique DNA sequence
aaccacgcccgccttctgat

SEQ ID NO: 2279 - DNA, 20 bp, Artificial
  20-mer unique DNA sequence
aaccttcttgggggcaggct

SEQ ID NO: 2280 - DNA, 20 bp, Artificial
  20-mer unique DNA sequence
cccattttactcgcccgtcg

SEQ ID NO: 2281 - DNA, 20 bp, Artificial
  20-mer unique DNA sequence
cacccgcagccctttgagtt

SEQ ID NO: 2282 - DNA, 20 bp, Artificial
  20-mer unique DNA sequence
cacagcacccctgaagccca

SEQ ID NO: 2283 - DNA, 20 bp, Artificial
  20-mer unique DNA sequence
caagcaccgcaactagccgc

SEQ ID NO: 2284 - DNA, 20 bp, Artificial
  20-mer unique DNA sequence
gcatttggcgccgagtcatt

SEQ ID NO: 2285 - DNA, 20 bp, Artificial
  20-mer unique DNA sequence
tccatcccagttcccagcgc

SEQ ID NO: 2286 - DNA, 20 bp, Artificial
  20-mer unique DNA sequence
tgtgctgggattgcggattg

SEQ ID NO: 2287 - DNA, 20 bp, Artificial
  20-mer unique DNA sequence
ggaatgtggcataacggcga

SEQ ID NO: 2288 - DNA, 20 bp, Artificial
  20-mer unique DNA sequence
aggcccaccaaccacgcttt

SEQ ID NO: 2289 - DNA, 20 bp, Artificial
  20-mer unique DNA sequence
ggttgtgggctgtgatgggc

SEQ ID NO: 2290 - DNA, 20 bp, Artificial
  20-mer unique DNA sequence
atcgggggggttgtttgtcg

SEQ ID NO: 2291 - DNA, 20 bp, Artificial
  20-mer unique DNA sequence
acgcggggaggagtgtacga

SEQ ID NO: 2292 - DNA, 20 bp, Artificial
  20-mer unique DNA sequence
ggctttacgctcgtgtgggg

SEQ ID NO: 2293 - DNA, 20 bp, Artificial
  20-mer unique DNA sequence
atgcttcccttcgtccgcct

SEQ ID NO: 2294 - DNA, 20 bp, Artificial
  20-mer unique DNA sequence
tatcccccccgtgtttgtgc

SEQ ID NO: 2295 - DNA, 20 bp, Artificial
  20-mer unique DNA sequence
cgcaaccccgctgacattta

SEQ ID NO: 2296 - DNA, 20 bp, Artificial
  20-mer unique DNA sequence
cgacgccatcttacccccct

SEQ ID NO: 2297 - DNA, 20 bp, Artificial
  20-mer unique DNA sequence
gccaaagcaatcagcgcaaa

SEQ ID NO: 2298 - DNA, 20 bp, Artificial
  20-mer unique DNA sequence
tctaccccctccgtccgatg

SEQ ID NO: 2299 - DNA, 20 bp, Artificial
  20-mer unique DNA sequence
gctagctgcccccccttcat

SEQ ID NO: 2300 - DNA, 20 bp, Artificial
  20-mer unique DNA sequence
cccagctttccgtttgcacc

SEQ ID NO: 2301 - DNA, 20 bp, Artificial
  20-mer unique DNA sequence
tcggggagtggggaacaacg

SEQ ID NO: 2302 - DNA, 20 bp, Artificial
  20-mer unique DNA sequence
tgccacaccgcgtcgaatct

SEQ ID NO: 2303 - DNA, 20 bp, Artificial
  20-mer unique DNA sequence
ataccgggaagcattgggcc

SEQ ID NO: 2304 - DNA, 20 bp, Artificial
  20-mer unique DNA sequence
ccgataggatggcgcaaacg

SEQ ID NO: 2305 - DNA, 20 bp, Artificial
  20-mer unique DNA sequence
tctagggcgctcggaatggc

SEQ ID NO: 2306 - DNA, 20 bp, Artificial
  20-mer unique DNA sequence
gaaccgacgcaaacccctga

SEQ ID NO: 2307 - DNA, 20 bp, Artificial
  20-mer unique DNA sequence
gggaaccggccaccaacaac

SEQ ID NO: 2308 - DNA, 20 bp, Artificial
  20-mer unique DNA sequence
gtgcggggtagtcgggggag

SEQ ID NO: 2309 - DNA, 20 bp, Artificial
  20-mer unique DNA sequence
ccgcgtgacatttgggctct

SEQ ID NO: 2310 - DNA, 20 bp, Artificial
  20-mer unique DNA sequence
ttcacctcgctggcctcgct

SEQ ID NO: 2311 - DNA, 20 bp, Artificial
  20-mer unique DNA sequence
agaattgaaggccccccgtc

SEQ ID NO: 2312 - DNA, 20 bp, Artificial
  20-mer unique DNA sequence
atcgttacaacccggtcgcc

SEQ ID NO: 2313 - DNA, 20 bp, Artificial
  20-mer unique DNA sequence
aaatggtgcggtcatgcggt

SEQ ID NO: 2314 - DNA, 20 bp, Artificial
  20-mer unique DNA sequence
cgcccagacaccacctccca

SEQ ID NO: 2315 - DNA, 20 bp, Artificial
  20-mer unique DNA sequence
tcgggagttttcgggatgga

SEQ ID NO: 2316 - DNA, 20 bp, Artificial
  20-mer unique DNA sequence
gggcggtttgcgaagaatgt

SEQ ID NO: 2317 - DNA, 20 bp, Artificial
  20-mer unique DNA sequence
cgaaggaggatggagcggcc

SEQ ID NO: 2318 - DNA, 20 bp, Artificial
  20-mer unique DNA sequence
gcattgttgcacacgggacc

SEQ ID NO: 2319 - DNA, 20 bp, Artificial
  20-mer unique DNA sequence
gttgcgggcgtagcctgggt

SEQ ID NO: 2320 - DNA, 20 bp, Artificial
  20-mer unique DNA sequence
acgcctatctacgtgcgacc

SEQ ID NO: 2321 - DNA, 20 bp, Artificial
  20-mer unique DNA sequence
agggcaccggacgaactgat

SEQ ID NO: 2322 - DNA, 20 bp, Artificial
  20-mer unique DNA sequence
ggacgttccccacctagcga

SEQ ID NO: 2323 - DNA, 20 bp, Artificial
  20-mer unique DNA sequence
tggcgatggattggaatgga

SEQ ID NO: 2324 - DNA, 20 bp, Artificial
  20-mer unique DNA sequence
ggctgaactgctccctacaa

SEQ ID NO: 2325 - DNA, 20 bp, Artificial
  20-mer unique DNA sequence
ggtggcactcggctgtacaa

SEQ ID NO: 2326 - DNA, 20 bp, Artificial
  20-mer unique DNA sequence
gtagatccgaccctggggca

SEQ ID NO: 2327 - DNA, 20 bp, Artificial
  20-mer unique DNA sequence
gtgtttacctacccgcgccc

SEQ ID NO: 2328 - DNA, 20 bp, Artificial
  20-mer unique DNA sequence
cagcgcggttggaatgaggc

SEQ ID NO: 2329 - DNA, 20 bp, Artificial
  20-mer unique DNA sequence
gccctgcttgcgctctgtcc

SEQ ID NO: 2330 - DNA, 20 bp, Artificial
  20-mer unique DNA sequence
ctcgcccacgttcaccctgt

SEQ ID NO: 2331 - DNA, 20 bp, Artificial
  20-mer unique DNA sequence
tttgtgggccgcggacttat

SEQ ID NO: 2332 - DNA, 20 bp, Artificial
  20-mer unique DNA sequence
aggctgcgtttgcgggaatg

SEQ ID NO: 2333 - DNA, 20 bp, Artificial
  20-mer unique DNA sequence
ggccgcgtctctccgttaac

SEQ ID NO: 2334 - DNA, 20 bp, Artificial
  20-mer unique DNA sequence
gcactgcgctgcatggtatc

SEQ ID NO: 2335 - DNA, 20 bp, Artificial
  20-mer unique DNA sequence
actggtccgcacgtagaagc

SEQ ID NO: 2336 - DNA, 20 bp, Artificial
  20-mer unique DNA sequence
tcgaaaaatgcgcgccacag

SEQ ID NO: 2337 - DNA, 20 bp, Artificial
  20-mer unique DNA sequence
actgcccgcccctcgtcaac

SEQ ID NO: 2338 - DNA, 20 bp, Artificial
  20-mer unique DNA sequence
taccgccccctagtgcacgc

SEQ ID NO: 2339 - DNA, 20 bp, Artificial
  20-mer unique DNA sequence
tagcggaggcaggcaacagg

SEQ ID NO: 2340 - DNA, 20 bp, Artificial
  20-mer unique DNA sequence
acggcgccaacttcttttcg

SEQ ID NO: 2341 - DNA, 20 bp, Artificial
  20-mer unique DNA sequence
gaaggttaggcagacggcgc

SEQ ID NO: 2342 - DNA, 20 bp, Artificial
  20-mer unique DNA sequence
cgcgcgggatgagctgatat

SEQ ID NO: 2343 - DNA, 20 bp, Artificial
  20-mer unique DNA sequence
gcggggaaaacaggcagcag

SEQ ID NO: 2344 - DNA, 20 bp, Artificial
  20-mer unique DNA sequence
atcagcgggcagcaggtttt

SEQ ID NO: 2345 - DNA, 20 bp, Artificial
  20-mer unique DNA sequence
aacgatcccattagccgcgc

SEQ ID NO: 2346 - DNA, 20 bp, Artificial
  20-mer unique DNA sequence
ccacgatgaagggcgcaatt

SEQ ID NO: 2347 - DNA, 20 bp, Artificial
  20-mer unique DNA sequence
tgtgcgttaagacgctcggc

SEQ ID NO: 2348 - DNA, 20 bp, Artificial
  20-mer unique DNA sequence
catgcgtgtccgacgcagaa

SEQ ID NO: 2349 - DNA, 20 bp, Artificial
  20-mer unique DNA sequence
gtggagcgcttagacagcga

SEQ ID NO: 2350 - DNA, 20 bp, Artificial
  20-mer unique DNA sequence
agctcgcgcctttacgttcc

SEQ ID NO: 2351 - DNA, 20 bp, Artificial
  20-mer unique DNA sequence
tcgggctccagattggcttc

SEQ ID NO: 2352 - DNA, 20 bp, Artificial
  20-mer unique DNA sequence
cggaatgttggacgcccctg

SEQ ID NO: 2353 - DNA, 20 bp, Artificial
  20-mer unique DNA sequence
aggggactggcgcggattta

SEQ ID NO: 2354 - DNA, 20 bp, Artificial
  20-mer unique DNA sequence
tggtgggacgtttgggcgag

SEQ ID NO: 2355 - DNA, 20 bp, Artificial
  20-mer unique DNA sequence
gtaggcccgactgcgaccat

SEQ ID NO: 2356 - DNA, 20 bp, Artificial
  20-mer unique DNA sequence
tgtcactagggcgaggggcg

SEQ ID NO: 2357 - DNA, 20 bp, Artificial
  20-mer unique DNA sequence
gggtgtcggagcggttggag

SEQ ID NO: 2358 - DNA, 20 bp, Artificial
  20-mer unique DNA sequence
tgtgagttggctttccgcgt

SEQ ID NO: 2359 - DNA, 20 bp, Artificial
  20-mer unique DNA sequence
ggccggcagacgctaattca

SEQ ID NO: 2360 - DNA, 20 bp, Artificial
  20-mer unique DNA sequence
ctcaatttcccgatgccggc

SEQ ID NO: 2361 - DNA, 20 bp, Artificial
  20-mer unique DNA sequence
ttggcaggcgctatcggttc

SEQ ID NO: 2362 - DNA, 20 bp, Artificial
  20-mer unique DNA sequence
acccactcccgtccgcctaa

SEQ ID NO: 2363 - DNA, 20 bp, Artificial
  20-mer unique DNA sequence
ctgtttcgccgggacttcgt

SEQ ID NO: 2364 - DNA, 20 bp, Artificial
  20-mer unique DNA sequence
ctgtttgatgcccactcccg

SEQ ID NO: 2365 - DNA, 20 bp, Artificial
  20-mer unique DNA sequence
gtaactacctcggcgcgggg

SEQ ID NO: 2366 - DNA, 20 bp, Artificial
  20-mer unique DNA sequence
cgtcccatcgctcgtccaat

SEQ ID NO: 2367 - DNA, 20 bp, Artificial
  20-mer unique DNA sequence
accccgcccccatctgtaac

SEQ ID NO: 2368 - DNA, 20 bp, Artificial
  20-mer unique DNA sequence
ggaacggttatgggtcgcga

SEQ ID NO: 2369 - DNA, 20 bp, Artificial
  20-mer unique DNA sequence
ggtgcttgcttctgggtcgg

SEQ ID NO: 2370 - DNA, 20 bp, Artificial
  20-mer unique DNA sequence
gaaatgaggcgatgaggcgg

SEQ ID NO: 2371 - DNA, 20 bp, Artificial
  20-mer unique DNA sequence
ctctcgtcctgccgcccaag

SEQ ID NO: 2372 - DNA, 20 bp, Artificial
  20-mer unique DNA sequence
tcacccgccgctcctttaac

SEQ ID NO: 2373 - DNA, 20 bp, Artificial
  20-mer unique DNA sequence
cggcaatcctcgcagacaac

SEQ ID NO: 2374 - DNA, 20 bp, Artificial
  20-mer unique DNA sequence
acacccgtcggcccttcttt

SEQ ID NO: 2375 - DNA, 20 bp, Artificial
  20-mer unique DNA sequence
aatcggtcgcgtgcaaagca

SEQ ID NO: 2376 - DNA, 20 bp, Artificial
  20-mer unique DNA sequence
tctacgcctccgcatcctcg

SEQ ID NO: 2377 - DNA, 20 bp, Artificial
  20-mer unique DNA sequence
atccgcgccagcccaatagt

SEQ ID NO: 2378 - DNA, 20 bp, Artificial
  20-mer unique DNA sequence
ctgcttttccctggccgtgc

SEQ ID NO: 2379 - DNA, 20 bp, Artificial
  20-mer unique DNA sequence
agcgcgtgtggtttcgatca

SEQ ID NO: 2380 - DNA, 20 bp, Artificial
  20-mer unique DNA sequence
tgatgtccgcgcaaaaacgt

SEQ ID NO: 2381 - DNA, 20 bp, Artificial
  20-mer unique DNA sequence
gcagagacgcgccgagacat

SEQ ID NO: 2382 - DNA, 20 bp, Artificial
  20-mer unique DNA sequence
gatgcgccaatccctccgtc

SEQ ID NO: 2383 - DNA, 20 bp, Artificial
  20-mer unique DNA sequence
catcggcgaagaaacacccg

SEQ ID NO: 2384 - DNA, 20 bp, Artificial
  20-mer unique DNA sequence
gacccgccaacgattccctc

SEQ ID NO: 2385 - DNA, 20 bp, Artificial
  20-mer unique DNA sequence
ttgctagcgcccaccccatg

SEQ ID NO: 2386 - DNA, 20 bp, Artificial
  20-mer unique DNA sequence
aagggatcaccctggtgcag

SEQ ID NO: 2387 - DNA, 20 bp, Artificial
  20-mer unique DNA sequence
tcgtctaggcaggacgccaa

SEQ ID NO: 2388 - DNA, 20 bp, Artificial
  20-mer unique DNA sequence
gggggagcgattgattggag

SEQ ID NO: 2389 - DNA, 20 bp, Artificial
  20-mer unique DNA sequence
aggggggcggacaagaaaga

SEQ ID NO: 2390 - DNA, 20 bp, Artificial
  20-mer unique DNA sequence
agcaacagggcgaggacgag

SEQ ID NO: 2391 - DNA, 20 bp, Artificial
  20-mer unique DNA sequence
cgggaacgcaatagggtggc

SEQ ID NO: 2392 - DNA, 20 bp, Artificial
  20-mer unique DNA sequence
cgcccccacgacctgctaac

SEQ ID NO: 2393 - DNA, 20 bp, Artificial
  20-mer unique DNA sequence
tatgagcaacgccccaccct

SEQ ID NO: 2394 - DNA, 20 bp, Artificial
  20-mer unique DNA sequence
cggtctgccgcatcatgtca

SEQ ID NO: 2395 - DNA, 20 bp, Artificial
  20-mer unique DNA sequence
acggctcccccgagtagagg

SEQ ID NO: 2396 - DNA, 20 bp, Artificial
  20-mer unique DNA sequence
actatgggcagcggggtcac

SEQ ID NO: 2397 - DNA, 20 bp, Artificial
  20-mer unique DNA sequence
atagcacgccccatttccga

SEQ ID NO: 2398 - DNA, 20 bp, Artificial
  20-mer unique DNA sequence
gacgagggcattgagcaggc

SEQ ID NO: 2399 - DNA, 20 bp, Artificial
  20-mer unique DNA sequence
taaggtgcggggttgcggtt

SEQ ID NO: 2400 - DNA, 20 bp, Artificial
  20-mer unique DNA sequence
ctggggggaaccttgcaaaa

SEQ ID NO: 2401 - DNA, 20 bp, Artificial
  20-mer unique DNA sequence
cgcacgcatatcagcccaag

SEQ ID NO: 2402 - DNA, 20 bp, Artificial
  20-mer unique DNA sequence
attcccccagaagccagccc

SEQ ID NO: 2403 - DNA, 20 bp, Artificial
  20-mer unique DNA sequence
cgccgaacgaccgacaacac

SEQ ID NO: 2404 - DNA, 20 bp, Artificial
  20-mer unique DNA sequence
cgtgggcatatgagggcgtt

SEQ ID NO: 2405 - DNA, 20 bp, Artificial
  20-mer unique DNA sequence
gcaaacgcggggataatggt

SEQ ID NO: 2406 - DNA, 20 bp, Artificial
  20-mer unique DNA sequence
cccaatgctaaggctcgacg

SEQ ID NO: 2407 - DNA, 20 bp, Artificial
  20-mer unique DNA sequence
tcccctgcaagcccacgata

SEQ ID NO: 2408 - DNA, 20 bp, Artificial
  20-mer unique DNA sequence
cccccgttttagcacttccg

SEQ ID NO: 2409 - DNA, 20 bp, Artificial
  20-mer unique DNA sequence
ttgatcgggtgcggggtagt

SEQ ID NO: 2410 - DNA, 20 bp, Artificial
  20-mer unique DNA sequence
ccatgtccaattccacggcg

SEQ ID NO: 2411 - DNA, 20 bp, Artificial
  20-mer unique DNA sequence
tgattcagcccccttgcagg

SEQ ID NO: 2412 - DNA, 20 bp, Artificial
  20-mer unique DNA sequence
tacccgccccgatgtcctag

SEQ ID NO: 2413 - DNA, 20 bp, Artificial
  20-mer unique DNA sequence
tagggggcggaaacatgatg

SEQ ID NO: 2414 - DNA, 20 bp, Artificial
  20-mer unique DNA sequence
cctttcccccttcgctgggt

SEQ ID NO: 2415 - DNA, 20 bp, Artificial
  20-mer unique DNA sequence
ggcccgcagccataaacaac

SEQ ID NO: 2416 - DNA, 20 bp, Artificial
  20-mer unique DNA sequence
ccgttcccttgtcgcctcgt

SEQ ID NO: 2417 - DNA, 20 bp, Artificial
  20-mer unique DNA sequence
ggaggcagacggggagtaaa

SEQ ID NO: 2418 - DNA, 20 bp, Artificial
  20-mer unique DNA sequence
gctcgcagcgcaagtgatta

SEQ ID NO: 2419 - DNA, 20 bp, Artificial
  20-mer unique DNA sequence
tgtaccccagtgcagccctt

SEQ ID NO: 2420 - DNA, 20 bp, Artificial
  20-mer unique DNA sequence
aactgctttactcgcggccc

SEQ ID NO: 2421 - DNA, 20 bp, Artificial
  20-mer unique DNA sequence
tgcccccattcgacctcttc

SEQ ID NO: 2422 - DNA, 20 bp, Artificial
  20-mer unique DNA sequence
ttcgcgccgtcttcttcaca

SEQ ID NO: 2423 - DNA, 20 bp, Artificial
  20-mer unique DNA sequence
ccgggccaccaaagacgatc

SEQ ID NO: 2424 - DNA, 20 bp, Artificial
  20-mer unique DNA sequence
acaaggccaacccatacggg

SEQ ID NO: 2425 - DNA, 20 bp, Artificial
  20-mer unique DNA sequence
agtacccccccccgatggag

SEQ ID NO: 2426 - DNA, 20 bp, Artificial
  20-mer unique DNA sequence
gcgtgattcgtctgggctgc

SEQ ID NO: 2427 - DNA, 20 bp, Artificial
  20-mer unique DNA sequence
tgtcggcgggggttgagaag

SEQ ID NO: 2428 - DNA, 20 bp, Artificial
  20-mer unique DNA sequence
tggcctgataagaacgcggg

SEQ ID NO: 2429 - DNA, 20 bp, Artificial
  20-mer unique DNA sequence
gagaccggggggaagcgaga

SEQ ID NO: 2430 - DNA, 20 bp, Artificial
  20-mer unique DNA sequence
caaaccgccaaaaaccaccg

SEQ ID NO: 2431 - DNA, 20 bp, Artificial
  20-mer unique DNA sequence
cctaatcccagtgtgccgcg

SEQ ID NO: 2432 - DNA, 20 bp, Artificial
  20-mer unique DNA sequence
gccccgaagctcgacagaaa

SEQ ID NO: 2433 - DNA, 20 bp, Artificial
  20-mer unique DNA sequence
gcccgtttgtcgatgggtgg

SEQ ID NO: 2434 - DNA, 20 bp, Artificial
  20-mer unique DNA sequence
atatggagccgggaaagcga

SEQ ID NO: 2435 - DNA, 20 bp, Artificial
  20-mer unique DNA sequence
ttttgggccgtgcagtagcg

SEQ ID NO: 2436 - DNA, 20 bp, Artificial
  20-mer unique DNA sequence
ttaccgccgaccgcctttag

SEQ ID NO: 2437 - DNA, 20 bp, Artificial
  20-mer unique DNA sequence
tttgagggtgcggagcgatg

SEQ ID NO: 2438 - DNA, 20 bp, Artificial
  20-mer unique DNA sequence
ccccggatccatgtagccct

SEQ ID NO: 2439 - DNA, 20 bp, Artificial
  20-mer unique DNA sequence
ccccttccgcaataacgcac

SEQ ID NO: 2440 - DNA, 20 bp, Artificial
  20-mer unique DNA sequence
tccgcacacgccagcataaa

SEQ ID NO: 2441 - DNA, 20 bp, Artificial
  20-mer unique DNA sequence
cgcgacgaatagccccagag

SEQ ID NO: 2442 - DNA, 20 bp, Artificial
  20-mer unique DNA sequence
gcaaccggggcgatgaatta

SEQ ID NO: 2443 - DNA, 20 bp, Artificial
  20-mer unique DNA sequence
ttggccttcgcgtcttttca

SEQ ID NO: 2444 - DNA, 20 bp, Artificial
  20-mer unique DNA sequence
gttccccagggcttttcgtg

SEQ ID NO: 2445 - DNA, 20 bp, Artificial
  20-mer unique DNA sequence
gagcccaacacagcgggagg

SEQ ID NO: 2446 - DNA, 20 bp, Artificial
  20-mer unique DNA sequence
aattgcactaggcgtcgggc

SEQ ID NO: 2447 - DNA, 20 bp, Artificial
  20-mer unique DNA sequence
ggccgccaccaccttaatgt

SEQ ID NO: 2448 - DNA, 20 bp, Artificial
  20-mer unique DNA sequence
atgccagccctccccgtaga

SEQ ID NO: 2449 - DNA, 20 bp, Artificial
  20-mer unique DNA sequence
caccctcctcgcacacgaaa

SEQ ID NO: 2450 - DNA, 20 bp, Artificial
  20-mer unique DNA sequence
ggcggcgttgatccagtgaa

SEQ ID NO: 2451 - DNA, 20 bp, Artificial
  20-mer unique DNA sequence
acccagaaagccgccgaaag

SEQ ID NO: 2452 - DNA, 20 bp, Artificial
  20-mer unique DNA sequence
ctccgctgctttccgcattg

SEQ ID NO: 2453 - DNA, 20 bp, Artificial
  20-mer unique DNA sequence
gagaggaggcggacgaaacg

SEQ ID NO: 2454 - DNA, 20 bp, Artificial
  20-mer unique DNA sequence
catacctggccgcgaacaca

SEQ ID NO: 2455 - DNA, 20 bp, Artificial
  20-mer unique DNA sequence
gttgcccatcgctccctcac

SEQ ID NO: 2456 - DNA, 20 bp, Artificial
  20-mer unique DNA sequence
tgcctgccgccgttatctcg

SEQ ID NO: 2457 - DNA, 20 bp, Artificial
  20-mer unique DNA sequence
tcccggacgtcagtctgttg

SEQ ID NO: 2458 - DNA, 20 bp, Artificial
  20-mer unique DNA sequence
tcgatagcggtcaggggcag

SEQ ID NO: 2459 - DNA, 20 bp, Artificial
  20-mer unique DNA sequence
acccaacccgtcccaagatg

SEQ ID NO: 2460 - DNA, 20 bp, Artificial
  20-mer unique DNA sequence
aatttccaccggcccaagct

SEQ ID NO: 2461 - DNA, 20 bp, Artificial
  20-mer unique DNA sequence
atgaacggcgtgaatgtccg

SEQ ID NO: 2462 - DNA, 20 bp, Artificial
  20-mer unique DNA sequence
ggcaaggggctgaaaaaggc

SEQ ID NO: 2463 - DNA, 20 bp, Artificial
  20-mer unique DNA sequence
atgaagcaagcacacccccc

SEQ ID NO: 2464 - DNA, 20 bp, Artificial
  20-mer unique DNA sequence
tccgggccgctgcctaaaac

SEQ ID NO: 2465 - DNA, 20 bp, Artificial
  20-mer unique DNA sequence
ccaatccccacccgtaaggc

SEQ ID NO: 2466 - DNA, 20 bp, Artificial
  20-mer unique DNA sequence
agcggcggtcacaattcaag

SEQ ID NO: 2467 - DNA, 20 bp, Artificial
  20-mer unique DNA sequence
cgcggggctgttgtatctcc

SEQ ID NO: 2468 - DNA, 20 bp, Artificial
  20-mer unique DNA sequence
tttcccgttcctatgccgtc

SEQ ID NO: 2469 - DNA, 20 bp, Artificial
  20-mer unique DNA sequence
tgaccaccatccacccgacg

SEQ ID NO: 2470 - DNA, 20 bp, Artificial
  20-mer unique DNA sequence
catcccgcacccccgtaaac

SEQ ID NO: 2471 - DNA, 20 bp, Artificial
  20-mer unique DNA sequence
ccacaaagactcgcggggac

SEQ ID NO: 2472 - DNA, 20 bp, Artificial
  20-mer unique DNA sequence
tcccaccggagtgaaccctt

SEQ ID NO: 2473 - DNA, 20 bp, Artificial
  20-mer unique DNA sequence
tacagccgcgtcgctaccat

SEQ ID NO: 2474 - DNA, 20 bp, Artificial
  20-mer unique DNA sequence
aggacctacggtcactggct

SEQ ID NO: 2475 - DNA, 20 bp, Artificial
  20-mer unique DNA sequence
tgaaggccactcctggggta

SEQ ID NO: 2476 - DNA, 20 bp, Artificial
  20-mer unique DNA sequence
cgtgggtctgttgaaggctg

SEQ ID NO: 2477 - DNA, 20 bp, Artificial
  20-mer unique DNA sequence
ccctcccaatcccagacgag

SEQ ID NO: 2478 - DNA, 20 bp, Artificial
  20-mer unique DNA sequence
ttccgccgccctgtctatcg

SEQ ID NO: 2479 - DNA, 20 bp, Artificial
  20-mer unique DNA sequence
aacggcgaagacaaccaccc

SEQ ID NO: 2480 - DNA, 20 bp, Artificial
  20-mer unique DNA sequence
gcccgcgctttcgacattta

SEQ ID NO: 2481 - DNA, 20 bp, Artificial
  20-mer unique DNA sequence
gcccgaagtaccgaaatagg

SEQ ID NO: 2482 - DNA, 20 bp, Artificial
  20-mer unique DNA sequence
cggtgtcagccacgacatca

SEQ ID NO: 2483 - DNA, 20 bp, Artificial
  20-mer unique DNA sequence
gacgctgcgatccacgtgtt

SEQ ID NO: 2484 - DNA, 20 bp, Artificial
  20-mer unique DNA sequence
cccccggcgtctaccttctc

SEQ ID NO: 2485 - DNA, 20 bp, Artificial
  20-mer unique DNA sequence
accgagccctgtgcacctca

SEQ ID NO: 2486 - DNA, 20 bp, Artificial
  20-mer unique DNA sequence
acaagcatcaggcgaccccc

SEQ ID NO: 2487 - DNA, 20 bp, Artificial
  20-mer unique DNA sequence
cgtgtcggcttggtttcact

SEQ ID NO: 2488 - DNA, 20 bp, Artificial
  20-mer unique DNA sequence
actttccccccgtgactgca

SEQ ID NO: 2489 - DNA, 20 bp, Artificial
  20-mer unique DNA sequence
agcccctgcactactccccc

SEQ ID NO: 2490 - DNA, 20 bp, Artificial
  20-mer unique DNA sequence
gggggtccaatagcgtgtgg

SEQ ID NO: 2491 - DNA, 20 bp, Artificial
  20-mer unique DNA sequence
accatccctgccgtcagcct

SEQ ID NO: 2492 - DNA, 20 bp, Artificial
  20-mer unique DNA sequence
tcccgacatcgcatcgcaaa

SEQ ID NO: 2493 - DNA, 20 bp, Artificial
  20-mer unique DNA sequence
accctacgccatgagccgcc

SEQ ID NO: 2494 - DNA, 20 bp, Artificial
  20-mer unique DNA sequence
ggacgacgaccccccaatgg

SEQ ID NO: 2495 - DNA, 20 bp, Artificial
  20-mer unique DNA sequence
gtcgcggcagcttctatgca

SEQ ID NO: 2496 - DNA, 20 bp, Artificial
  20-mer unique DNA sequence
ctagaaggcatcgcgcgcct

SEQ ID NO: 2497 - DNA, 20 bp, Artificial
  20-mer unique DNA sequence
tacgcccgcccttcacatcc

SEQ ID NO: 2498 - DNA, 20 bp, Artificial
  20-mer unique DNA sequence
aagacccgctgcccctcagt

SEQ ID NO: 2499 - DNA, 20 bp, Artificial
  20-mer unique DNA sequence
cccaagttcctcaccgctcg

SEQ ID NO: 2500 - DNA, 20 bp, Artificial
  20-mer unique DNA sequence
ccggaccacctcgcacaatt

SEQ ID NO: 2501 - DNA, 20 bp, Artificial
  20-mer unique DNA sequence
aagtcccggtctcgtcgcct

SEQ ID NO: 2502 - DNA, 20 bp, Artificial
  20-mer unique DNA sequence
atgacgtcggaggggcggag

SEQ ID NO: 2503 - DNA, 20 bp, Artificial
  20-mer unique DNA sequence
ctggcaacgaaacgacgctc

SEQ ID NO: 2504 - DNA, 20 bp, Artificial
  20-mer unique DNA sequence
gctgagatttgccggggagg

SEQ ID NO: 2505 - DNA, 20 bp, Artificial
  20-mer unique DNA sequence
gtaccgcggctgttgctgca

SEQ ID NO: 2506 - DNA, 20 bp, Artificial
  20-mer unique DNA sequence
tcgggaggcgaggtcagatt

SEQ ID NO: 2507 - DNA, 20 bp, Artificial
  20-mer unique DNA sequence
ggggcaactggggaacgagc

SEQ ID NO: 2508 - DNA, 20 bp, Artificial
  20-mer unique DNA sequence
caggtgaggtgaatcggccg

SEQ ID NO: 2509 - DNA, 20 bp, Artificial
  20-mer unique DNA sequence
taggaggacgaagccgggcg

SEQ ID NO: 2510 - DNA, 20 bp, Artificial
  20-mer unique DNA sequence
ttatcggcgccaattcccag

SEQ ID NO: 2511 - DNA, 20 bp, Artificial
  20-mer unique DNA sequence
cgagccgccacttgcatgag

SEQ ID NO: 2512 - DNA, 20 bp, Artificial
  20-mer unique DNA sequence
tgctcctccccccaaacaac

SEQ ID NO: 2513 - DNA, 20 bp, Artificial
  20-mer unique DNA sequence
atgggtggggtgaatccgga

SEQ ID NO: 2514 - DNA, 20 bp, Artificial
  20-mer unique DNA sequence
aaacaccccaggccacgcag

SEQ ID NO: 2515 - DNA, 20 bp, Artificial
  20-mer unique DNA sequence
aaactagcgaggcggcgaaa

SEQ ID NO: 2516 - DNA, 20 bp, Artificial
  20-mer unique DNA sequence
catggggagcgttttggggg

SEQ ID NO: 2517 - DNA, 20 bp, Artificial
  20-mer unique DNA sequence
cttctagctggcgctccgtt

SEQ ID NO: 2518 - DNA, 20 bp, Artificial
  20-mer unique DNA sequence
caccccgcgctcctttccta

SEQ ID NO: 2519 - DNA, 20 bp, Artificial
  20-mer unique DNA sequence
gcctcatgaatcccccccag

SEQ ID NO: 2520 - DNA, 20 bp, Artificial
  20-mer unique DNA sequence
tggcggtgggggggatacta

SEQ ID NO: 2521 - DNA, 20 bp, Artificial
  20-mer unique DNA sequence
aagtgggctaatgcgggggc

SEQ ID NO: 2522 - DNA, 20 bp, Artificial
  20-mer unique DNA sequence
tcatcggaatcaacgctcgc

SEQ ID NO: 2523 - DNA, 20 bp, Artificial
  20-mer unique DNA sequence
cgacttatgcgcgcgggagt

SEQ ID NO: 2524 - DNA, 20 bp, Artificial
  20-mer unique DNA sequence
ccacgcgcctaccttcccag

SEQ ID NO: 2525 - DNA, 20 bp, Artificial
  20-mer unique DNA sequence
gctgcggccatctcaacctg

SEQ ID NO: 2526 - DNA, 20 bp, Artificial
  20-mer unique DNA sequence
gcacgcctagcagacgcacc

SEQ ID NO: 2527 - DNA, 20 bp, Artificial
  20-mer unique DNA sequence
ggcccagtagttccagcgca

SEQ ID NO: 2528 - DNA, 20 bp, Artificial
  20-mer unique DNA sequence
gcgaggtggatgccggttga

SEQ ID NO: 2529 - DNA, 20 bp, Artificial
  20-mer unique DNA sequence
cattggcctcgatcgcgtta

SEQ ID NO: 2530 - DNA, 20 bp, Artificial
  20-mer unique DNA sequence
agttaggggggcggactcat

SEQ ID NO: 2531 - DNA, 20 bp, Artificial
  20-mer unique DNA sequence
cgcctgaccccctaaaccga

SEQ ID NO: 2532 - DNA, 20 bp, Artificial
  20-mer unique DNA sequence
cgcgtgaggtagtccggtta

SEQ ID NO: 2533 - DNA, 20 bp, Artificial
  20-mer unique DNA sequence
atctcacgcgcaagcctgat

SEQ ID NO: 2534 - DNA, 20 bp, Artificial
  20-mer unique DNA sequence
tgcagctgaggatgggacgt

SEQ ID NO: 2535 - DNA, 20 bp, Artificial
  20-mer unique DNA sequence
gctgggaattgggcacgtgg

SEQ ID NO: 2536 - DNA, 20 bp, Artificial
  20-mer unique DNA sequence
agaggagggcaaggatgggc

SEQ ID NO: 2537 - DNA, 20 bp, Artificial
  20-mer unique DNA sequence
tctgcgggatgtagggagcc

SEQ ID NO: 2538 - DNA, 20 bp, Artificial
  20-mer unique DNA sequence
ttgctcctccggcgtcttgg

SEQ ID NO: 2539 - DNA, 20 bp, Artificial
  20-mer unique DNA sequence
ggagatttggcgagggcgta

SEQ ID NO: 2540 - DNA, 20 bp, Artificial
  20-mer unique DNA sequence
cggcccgaactgtagcgaca

SEQ ID NO: 2541 - DNA, 20 bp, Artificial
  20-mer unique DNA sequence
cctcatgaagcggggatgcc

SEQ ID NO: 2542 - DNA, 20 bp, Artificial
  20-mer unique DNA sequence
ccgggcccacttgatggatt

SEQ ID NO: 2543 - DNA, 20 bp, Artificial
  20-mer unique DNA sequence
gacgccaccaccttcgcgac

SEQ ID NO: 2544 - DNA, 20 bp, Artificial
  20-mer unique DNA sequence
atcgcctctcccacgctcat

SEQ ID NO: 2545 - DNA, 20 bp, Artificial
  20-mer unique DNA sequence
cccccccgcctatatcgtct

SEQ ID NO: 2546 - DNA, 20 bp, Artificial
  20-mer unique DNA sequence
tccacctcagcgcaaaagcc

SEQ ID NO: 2547 - DNA, 20 bp, Artificial
  20-mer unique DNA sequence
ccgtcggcgtagccccatat

SEQ ID NO: 2548 - DNA, 20 bp, Artificial
  20-mer unique DNA sequence
cggcccggactgttggagtg

SEQ ID NO: 2549 - DNA, 20 bp, Artificial
  20-mer unique DNA sequence
tgggtgggtcggttctaggc

SEQ ID NO: 2550 - DNA, 20 bp, Artificial
  20-mer unique DNA sequence
cgcttcgccctattccgtca

SEQ ID NO: 2551 - DNA, 20 bp, Artificial
  20-mer unique DNA sequence
tggatgttgtggtcgggggt

SEQ ID NO: 2552 - DNA, 20 bp, Artificial
  20-mer unique DNA sequence
gcgcctgttgggtttgtcgg

SEQ ID NO: 2553 - DNA, 20 bp, Artificial
  20-mer unique DNA sequence
gtcgcgcggatattcgtttg

SEQ ID NO: 2554 - DNA, 20 bp, Artificial
  20-mer unique DNA sequence
taggacacgctggggggaat

SEQ ID NO: 2555 - DNA, 20 bp, Artificial
  20-mer unique DNA sequence
ggccgctttgcacctttccc

SEQ ID NO: 2556 - DNA, 20 bp, Artificial
  20-mer unique DNA sequence
gccaacaccagaaccacggg

SEQ ID NO: 2557 - DNA, 20 bp, Artificial
  20-mer unique DNA sequence
cacggccttcccttgtcacc

SEQ ID NO: 2558 - DNA, 20 bp, Artificial
  20-mer unique DNA sequence
tggctaccgcttgaccccat

SEQ ID NO: 2559 - DNA, 20 bp, Artificial
  20-mer unique DNA sequence
gattgacacccttggcgccc

SEQ ID NO: 2560 - DNA, 20 bp, Artificial
  20-mer unique DNA sequence
acagacggagttggcgccga

SEQ ID NO: 2561 - DNA, 20 bp, Artificial
  20-mer unique DNA sequence
tgggaaggtgaaaacccgcg

SEQ ID NO: 2562 - DNA, 20 bp, Artificial
  20-mer unique DNA sequence
ccgttaacatcccgcacgca

SEQ ID NO: 2563 - DNA, 20 bp, Artificial
  20-mer unique DNA sequence
cgtctcagtccgcgcatcaa

SEQ ID NO: 2564 - DNA, 20 bp, Artificial
  20-mer unique DNA sequence
gtgggcggcttatgggacag

SEQ ID NO: 2565 - DNA, 20 bp, Artificial
  20-mer unique DNA sequence
tgttctaagctcgcgcctgc

SEQ ID NO: 2566 - DNA, 20 bp, Artificial
  20-mer unique DNA sequence
gatcgcaccccaaccggtaa

SEQ ID NO: 2567 - DNA, 20 bp, Artificial
  20-mer unique DNA sequence
gtttttgcctccacggacct

SEQ ID NO: 2568 - DNA, 20 bp, Artificial
  20-mer unique DNA sequence
gaccgttcgctggggagtga

SEQ ID NO: 2569 - DNA, 20 bp, Artificial
  20-mer unique DNA sequence
aaaccgcgggcaacgtacaa

SEQ ID NO: 2570 - DNA, 20 bp, Artificial
  20-mer unique DNA sequence
cggccccgtgtttactcgtt

SEQ ID NO: 2571 - DNA, 20 bp, Artificial
  20-mer unique DNA sequence
cacgccccgttaccgtcata

SEQ ID NO: 2572 - DNA, 20 bp, Artificial
  20-mer unique DNA sequence
tctccgctcgctgtcattcg

SEQ ID NO: 2573 - DNA, 20 bp, Artificial
  20-mer unique DNA sequence
caggggtcgtgcacttgggc

SEQ ID NO: 2574 - DNA, 20 bp, Artificial
  20-mer unique DNA sequence
aaagaacccgcgccaaaccg

SEQ ID NO: 2575 - DNA, 20 bp, Artificial
  20-mer unique DNA sequence
cgtgtgtgggggggtgttct

SEQ ID NO: 2576 - DNA, 20 bp, Artificial
  20-mer unique DNA sequence
cgtagcacggccaatggaaa

SEQ ID NO: 2577 - DNA, 20 bp, Artificial
  20-mer unique DNA sequence
taccctgccctaacggtccg

SEQ ID NO: 2578 - DNA, 20 bp, Artificial
  20-mer unique DNA sequence
tccatctaaccccgccatcg

SEQ ID NO: 2579 - DNA, 20 bp, Artificial
  20-mer unique DNA sequence
tttgctgggttagggggctg

SEQ ID NO: 2580 - DNA, 20 bp, Artificial
  20-mer unique DNA sequence
gcccgccttgctgaatgtct

SEQ ID NO: 2581 - DNA, 20 bp, Artificial
  20-mer unique DNA sequence
cgaaacgcaacggaggtcaa

SEQ ID NO: 2582 - DNA, 20 bp, Artificial
  20-mer unique DNA sequence
gcaggctgatgacccccaga

SEQ ID NO: 2583 - DNA, 20 bp, Artificial
  20-mer unique DNA sequence
ccaggtagcgcggggggtaa

SEQ ID NO: 2584 - DNA, 20 bp, Artificial
  20-mer unique DNA sequence
gctgcaggtccacttcacag

SEQ ID NO: 2585 - DNA, 20 bp, Artificial
  20-mer unique DNA sequence
cgtgtggtgcttgcgttccg

SEQ ID NO: 2586 - DNA, 20 bp, Artificial
  20-mer unique DNA sequence
agggcggcctgaactggttt

SEQ ID NO: 2587 - DNA, 20 bp, Artificial
  20-mer unique DNA sequence
tgccaggctaggcccctaat

SEQ ID NO: 2588 - DNA, 20 bp, Artificial
  20-mer unique DNA sequence
cacggccggtagatgcacaa

SEQ ID NO: 2589 - DNA, 20 bp, Artificial
  20-mer unique DNA sequence
atttccgggggtatctcgcg

SEQ ID NO: 2590 - DNA, 20 bp, Artificial
  20-mer unique DNA sequence
acccccgatgtcccctacaa

SEQ ID NO: 2591 - DNA, 20 bp, Artificial
  20-mer unique DNA sequence
atggcgattggggagagacg

SEQ ID NO: 2592 - DNA, 20 bp, Artificial
  20-mer unique DNA sequence
cgggtgcgtgagcctgataa

SEQ ID NO: 2593 - DNA, 20 bp, Artificial
  20-mer unique DNA sequence
cctcgttcccacgtcttccg

SEQ ID NO: 2594 - DNA, 20 bp, Artificial
  20-mer unique DNA sequence
tgtctcttaggcgacctgcg

SEQ ID NO: 2595 - DNA, 20 bp, Artificial
  20-mer unique DNA sequence
tacacgtatgactggccggg

SEQ ID NO: 2596 - DNA, 20 bp, Artificial
  20-mer unique DNA sequence
tccacttcgcacccgctttg

SEQ ID NO: 2597 - DNA, 20 bp, Artificial
  20-mer unique DNA sequence
gggggggtggccatatatcg

SEQ ID NO: 2598 - DNA, 20 bp, Artificial
  20-mer unique DNA sequence
ggtcgtcgagttgggggctg

SEQ ID NO: 2599 - DNA, 20 bp, Artificial
  20-mer unique DNA sequence
ccggcttgcttttgggagct

SEQ ID NO: 2600 - DNA, 20 bp, Artificial
  20-mer unique DNA sequence
aggtcggagcaaggcaggtg

SEQ ID NO: 2601 - DNA, 20 bp, Artificial
  20-mer unique DNA sequence
gcaggcgcgttgggcttatc

SEQ ID NO: 2602 - DNA, 20 bp, Artificial
  20-mer unique DNA sequence
agtaggactcgggggcggtg

SEQ ID NO: 2603 - DNA, 20 bp, Artificial
  20-mer unique DNA sequence
tttgggggagggttgaatgg

SEQ ID NO: 2604 - DNA, 20 bp, Artificial
  20-mer unique DNA sequence
ttgggctaccttggcatcgg

SEQ ID NO: 2605 - DNA, 20 bp, Artificial
  20-mer unique DNA sequence
tttgcggaggggggagacag

SEQ ID NO: 2606 - DNA, 20 bp, Artificial
  20-mer unique DNA sequence
gcagccttcggctagctcat

SEQ ID NO: 2607 - DNA, 20 bp, Artificial
  20-mer unique DNA sequence
aaaggcgattcgctggcaca

SEQ ID NO: 2608 - DNA, 20 bp, Artificial
  20-mer unique DNA sequence
gacattttggcgggcggaga

SEQ ID NO: 2609 - DNA, 20 bp, Artificial
  20-mer unique DNA sequence
gcggatgggggtgttgggac

SEQ ID NO: 2610 - DNA, 20 bp, Artificial
  20-mer unique DNA sequence
aggatgtgggggctacgggt

SEQ ID NO: 2611 - DNA, 20 bp, Artificial
  20-mer unique DNA sequence
aaggtgggcaggggcaaatc

SEQ ID NO: 2612 - DNA, 20 bp, Artificial
  20-mer unique DNA sequence
tcccgccaccgtctgtttgc

SEQ ID NO: 2613 - DNA, 20 bp, Artificial
  20-mer unique DNA sequence
agctagcgtcagcgactgag

SEQ ID NO: 2614 - DNA, 20 bp, Artificial
  20-mer unique DNA sequence
agtctcggttcgcgtgccca

SEQ ID NO: 2615 - DNA, 20 bp, Artificial
  20-mer unique DNA sequence
aagcctaggtccccccgcac

SEQ ID NO: 2616 - DNA, 20 bp, Artificial
  20-mer unique DNA sequence
ccggtccacgatcttcactc

SEQ ID NO: 2617 - DNA, 20 bp, Artificial
  20-mer unique DNA sequence
tataaggcgccaatccccga

SEQ ID NO: 2618 - DNA, 20 bp, Artificial
  20-mer unique DNA sequence
ccgttcgtttattcgcccgt

SEQ ID NO: 2619 - DNA, 20 bp, Artificial
  20-mer unique DNA sequence
agcgaggggaacaggcgagg

SEQ ID NO: 2620 - DNA, 20 bp, Artificial
  20-mer unique DNA sequence
atcccacccgccatgaagac

SEQ ID NO: 2621 - DNA, 20 bp, Artificial
  20-mer unique DNA sequence
gcgttctccggcacatgttg

SEQ ID NO: 2622 - DNA, 20 bp, Artificial
  20-mer unique DNA sequence
tgcatatctcgatcgcggca

SEQ ID NO: 2623 - DNA, 20 bp, Artificial
  20-mer unique DNA sequence
acgaatccgcacgaacccct

SEQ ID NO: 2624 - DNA, 20 bp, Artificial
  20-mer unique DNA sequence
cccgttgttcgtctcccctg

SEQ ID NO: 2625 - DNA, 20 bp, Artificial
  20-mer unique DNA sequence
tgtttaggcgatgggcggtg

SEQ ID NO: 2626 - DNA, 20 bp, Artificial
  20-mer unique DNA sequence
ctctcaataagggcgccgga

SEQ ID NO: 2627 - DNA, 20 bp, Artificial
  20-mer unique DNA sequence
gcaccgatcgcctaggaacc

SEQ ID NO: 2628 - DNA, 20 bp, Artificial
  20-mer unique DNA sequence
gccagccaacgaccaatccg

SEQ ID NO: 2629 - DNA, 20 bp, Artificial
  20-mer unique DNA sequence
gggctttggtatcgctgggg

SEQ ID NO: 2630 - DNA, 20 bp, Artificial
  20-mer unique DNA sequence
tagcgctgccggacgtagta

SEQ ID NO: 2631 - DNA, 20 bp, Artificial
  20-mer unique DNA sequence
tcacgggctagtccttccca

SEQ ID NO: 2632 - DNA, 20 bp, Artificial
  20-mer unique DNA sequence
ggtctaagcggcgtcccaca

SEQ ID NO: 2633 - DNA, 20 bp, Artificial
  20-mer unique DNA sequence
ccgtcgtgggcgtgataggg

SEQ ID NO: 2634 - DNA, 20 bp, Artificial
  20-mer unique DNA sequence
taggctgatttggcgggcat

SEQ ID NO: 2635 - DNA, 20 bp, Artificial
  20-mer unique DNA sequence
ctgggaggagtgcgaagggg

SEQ ID NO: 2636 - DNA, 20 bp, Artificial
  20-mer unique DNA sequence
tgtcattcgggcaggtcggc

SEQ ID NO: 2637 - DNA, 20 bp, Artificial
  20-mer unique DNA sequence
ggttgcgggtctgttggaag

SEQ ID NO: 2638 - DNA, 20 bp, Artificial
  20-mer unique DNA sequence
gagcgcgcgacgaagatcta

SEQ ID NO: 2639 - DNA, 20 bp, Artificial
  20-mer unique DNA sequence
actgcaacggctggtgggct

SEQ ID NO: 2640 - DNA, 20 bp, Artificial
  20-mer unique DNA sequence
cggccgcatcctctttgagt

SEQ ID NO: 2641 - DNA, 20 bp, Artificial
  20-mer unique DNA sequence
cggcttccctcccgttgact

SEQ ID NO: 2642 - DNA, 20 bp, Artificial
  20-mer unique DNA sequence
ggcggtaacaagcgggtcag

SEQ ID NO: 2643 - DNA, 20 bp, Artificial
  20-mer unique DNA sequence
cgctggccgggtgactttaa

SEQ ID NO: 2644 - DNA, 20 bp, Artificial
  20-mer unique DNA sequence
ccccctcggccactctaacg

SEQ ID NO: 2645 - DNA, 20 bp, Artificial
  20-mer unique DNA sequence
ctgtaggcgggaagcgggtc

SEQ ID NO: 2646 - DNA, 20 bp, Artificial
  20-mer unique DNA sequence
cgggcgcacattctgagctg

SEQ ID NO: 2647 - DNA, 20 bp, Artificial
  20-mer unique DNA sequence
ccgaatggagacaggccacc

SEQ ID NO: 2648 - DNA, 20 bp, Artificial
  20-mer unique DNA sequence
cctgcgccaccttgacacga

SEQ ID NO: 2649 - DNA, 20 bp, Artificial
  20-mer unique DNA sequence
cagttccgggcgcacaaacc

SEQ ID NO: 2650 - DNA, 20 bp, Artificial
  20-mer unique DNA sequence
acacaccctcgcatgccaaa

SEQ ID NO: 2651 - DNA, 20 bp, Artificial
  20-mer unique DNA sequence
gggggacggtgtggggagag

SEQ ID NO: 2652 - DNA, 20 bp, Artificial
  20-mer unique DNA sequence
cgcggggatggctggaataa

SEQ ID NO: 2653 - DNA, 20 bp, Artificial
  20-mer unique DNA sequence
tttggggaaggtcgtgggcc

SEQ ID NO: 2654 - DNA, 20 bp, Artificial
  20-mer unique DNA sequence
ccaggcctcttcaacccgcc

SEQ ID NO: 2655 - DNA, 20 bp, Artificial
  20-mer unique DNA sequence
gtgcctttgcgggtgttgct

SEQ ID NO: 2656 - DNA, 20 bp, Artificial
  20-mer unique DNA sequence
tgtttgggcctcatggcagc

SEQ ID NO: 2657 - DNA, 20 bp, Artificial
  20-mer unique DNA sequence
ccatcaccgctttgagccaa

SEQ ID NO: 2658 - DNA, 20 bp, Artificial
  20-mer unique DNA sequence
cgccaacataagctccccgc

SEQ ID NO: 2659 - DNA, 20 bp, Artificial
  20-mer unique DNA sequence
atcgcggtggggcaagtcag

SEQ ID NO: 2660 - DNA, 20 bp, Artificial
  20-mer unique DNA sequence
aaacccagacgccaaagcca

SEQ ID NO: 2661 - DNA, 20 bp, Artificial
  20-mer unique DNA sequence
catcatccacccccacggct

SEQ ID NO: 2662 - DNA, 20 bp, Artificial
  20-mer unique DNA sequence
gactggggaacctcgggacg

SEQ ID NO: 2663 - DNA, 20 bp, Artificial
  20-mer unique DNA sequence
attgcccctcccacacgaag

SEQ ID NO: 2664 - DNA, 20 bp, Artificial
  20-mer unique DNA sequence
gtgggcatttttcgcttggc

SEQ ID NO: 2665 - DNA, 20 bp, Artificial
  20-mer unique DNA sequence
tgcttgcccgagaccctgtc

SEQ ID NO: 2666 - DNA, 20 bp, Artificial
  20-mer unique DNA sequence
cccgcccaaagtctgccctc

SEQ ID NO: 2667 - DNA, 20 bp, Artificial
  20-mer unique DNA sequence
cgatgcgccacaccctaccc

SEQ ID NO: 2668 - DNA, 20 bp, Artificial
  20-mer unique DNA sequence
agctttttgatcgcgcggag

SEQ ID NO: 2669 - DNA, 20 bp, Artificial
  20-mer unique DNA sequence
ggcgccggctgtcttcttgt

SEQ ID NO: 2670 - DNA, 20 bp, Artificial
  20-mer unique DNA sequence
gtgtacatgtctgcggcggg

SEQ ID NO: 2671 - DNA, 20 bp, Artificial
  20-mer unique DNA sequence
gtgtgtgatggaggcccgtg

SEQ ID NO: 2672 - DNA, 20 bp, Artificial
  20-mer unique DNA sequence
tcagaaaccagatcggggcg

SEQ ID NO: 2673 - DNA, 20 bp, Artificial
  20-mer unique DNA sequence
ttgataattgcccgtgcccc

SEQ ID NO: 2674 - DNA, 20 bp, Artificial
  20-mer unique DNA sequence
gcttctagatcggggcgcac

SEQ ID NO: 2675 - DNA, 20 bp, Artificial
  20-mer unique DNA sequence
cccaaacatacccgtgcgcg

SEQ ID NO: 2676 - DNA, 20 bp, Artificial
  20-mer unique DNA sequence
ccacttgaatcccggcaccg

SEQ ID NO: 2677 - DNA, 20 bp, Artificial
  20-mer unique DNA sequence
cgcgaaccccaccaaagcct

SEQ ID NO: 2678 - DNA, 20 bp, Artificial
  20-mer unique DNA sequence
ccctccgcttcgccctgtag

SEQ ID NO: 2679 - DNA, 20 bp, Artificial
  20-mer unique DNA sequence
ggatgaggggaccgggagct

SEQ ID NO: 2680 - DNA, 20 bp, Artificial
  20-mer unique DNA sequence
tcggggggtaggcggacagt

SEQ ID NO: 2681 - DNA, 20 bp, Artificial
  20-mer unique DNA sequence
catgttggggcgcgatttga

SEQ ID NO: 2682 - DNA, 20 bp, Artificial
  20-mer unique DNA sequence
cgctctgatcagtgagccct

SEQ ID NO: 2683 - DNA, 20 bp, Artificial
  20-mer unique DNA sequence
ccgtgttgcagtgccggata

SEQ ID NO: 2684 - DNA, 20 bp, Artificial
  20-mer unique DNA sequence
acatttttgggggtggttcg

SEQ ID NO: 2685 - DNA, 20 bp, Artificial
  20-mer unique DNA sequence
cgagaaggccaacaggggga

SEQ ID NO: 2686 - DNA, 20 bp, Artificial
  20-mer unique DNA sequence
tccccgaacggtaatccgca

SEQ ID NO: 2687 - DNA, 20 bp, Artificial
  20-mer unique DNA sequence
ttattgcgggcggcggttat

SEQ ID NO: 2688 - DNA, 20 bp, Artificial
  20-mer unique DNA sequence
acagagcgtggccgaggtgg

SEQ ID NO: 2689 - DNA, 20 bp, Artificial
  20-mer unique DNA sequence
acccccgaccaacgcacaca

SEQ ID NO: 2690 - DNA, 20 bp, Artificial
  20-mer unique DNA sequence
gatgagtgcggtgaacgggg

SEQ ID NO: 2691 - DNA, 20 bp, Artificial
  20-mer unique DNA sequence
ccactcgcgttccctttcgt

SEQ ID NO: 2692 - DNA, 20 bp, Artificial
  20-mer unique DNA sequence
atcacaccgtgcgtatcccg

SEQ ID NO: 2693 - DNA, 20 bp, Artificial
  20-mer unique DNA sequence
acgagcgcctagtgaggcaa

SEQ ID NO: 2694 - DNA, 20 bp, Artificial
  20-mer unique DNA sequence
ctacggaggaggggatgcga

SEQ ID NO: 2695 - DNA, 20 bp, Artificial
  20-mer unique DNA sequence
gccccgtgacagcccaattt

SEQ ID NO: 2696 - DNA, 20 bp, Artificial
  20-mer unique DNA sequence
ctttgggagatgctgcgcgg

SEQ ID NO: 2697 - DNA, 20 bp, Artificial
  20-mer unique DNA sequence
cagtaacggcctcatgccca

SEQ ID NO: 2698 - DNA, 20 bp, Artificial
  20-mer unique DNA sequence
ccgcgccgagtagaggagaa

SEQ ID NO: 2699 - DNA, 20 bp, Artificial
  20-mer unique DNA sequence
tggaagagagcgggatgggc

SEQ ID NO: 2700 - DNA, 20 bp, Artificial
  20-mer unique DNA sequence
gcggtcggaggggtggaaat

SEQ ID NO: 2701 - DNA, 20 bp, Artificial
  20-mer unique DNA sequence
acctcctcccccctcggtaa

SEQ ID NO: 2702 - DNA, 20 bp, Artificial
  20-mer unique DNA sequence
ccaaattcgctagcacgccg

SEQ ID NO: 2703 - DNA, 20 bp, Artificial
  20-mer unique DNA sequence
acgggtcatgttgggggtgt

SEQ ID NO: 2704 - DNA, 20 bp, Artificial
  20-mer unique DNA sequence
ccaaattcgctgcttcccag

SEQ ID NO: 2705 - DNA, 20 bp, Artificial
  20-mer unique DNA sequence
tagctgcgtggggggattca

SEQ ID NO: 2706 - DNA, 20 bp, Artificial
  20-mer unique DNA sequence
aagtctcgtcgacacgtccc

SEQ ID NO: 2707 - DNA, 20 bp, Artificial
  20-mer unique DNA sequence
cacttactggggacccgctt

SEQ ID NO: 2708 - DNA, 20 bp, Artificial
  20-mer unique DNA sequence
cggcagcacccttgcccgag

SEQ ID NO: 2709 - DNA, 20 bp, Artificial
  20-mer unique DNA sequence
tgaatgggggggaaacagcg

SEQ ID NO: 2710 - DNA, 20 bp, Artificial
  20-mer unique DNA sequence
ggaaggttggcttgagggat

SEQ ID NO: 2711 - DNA, 20 bp, Artificial
  20-mer unique DNA sequence
ccacccactcctgctccgct

SEQ ID NO: 2712 - DNA, 20 bp, Artificial
  20-mer unique DNA sequence
ccgggcaatttctccctgat

SEQ ID NO: 2713 - DNA, 20 bp, Artificial
  20-mer unique DNA sequence
cgtcaagtagtcaggcccgt

SEQ ID NO: 2714 - DNA, 20 bp, Artificial
  20-mer unique DNA sequence
caacaacgcgccagagaagg

SEQ ID NO: 2715 - DNA, 20 bp, Artificial
  20-mer unique DNA sequence
ccctccgccaacgaaacgat

SEQ ID NO: 2716 - DNA, 20 bp, Artificial
  20-mer unique DNA sequence
attgaaggcccctacgcccc

SEQ ID NO: 2717 - DNA, 20 bp, Artificial
  20-mer unique DNA sequence
agttgcaggcgggcatgtga

SEQ ID NO: 2718 - DNA, 20 bp, Artificial
  20-mer unique DNA sequence
agacacgcctaccgccgacc

SEQ ID NO: 2719 - DNA, 20 bp, Artificial
  20-mer unique DNA sequence
tttcaagggtttcgtgccgc

SEQ ID NO: 2720 - DNA, 20 bp, Artificial
  20-mer unique DNA sequence
taggttcggacagtcgagcg

SEQ ID NO: 2721 - DNA, 20 bp, Artificial
  20-mer unique DNA sequence
acaccgcgtcgaaagccacg

SEQ ID NO: 2722 - DNA, 20 bp, Artificial
  20-mer unique DNA sequence
gcccctcagtgcccctccaa

SEQ ID NO: 2723 - DNA, 20 bp, Artificial
  20-mer unique DNA sequence
tgaactatccccatcgcccc

SEQ ID NO: 2724 - DNA, 20 bp, Artificial
  20-mer unique DNA sequence
aggcgacgtgcacggtaatg

SEQ ID NO: 2725 - DNA, 20 bp, Artificial
  20-mer unique DNA sequence
gcgagagggcagcatagcgg

SEQ ID NO: 2726 - DNA, 20 bp, Artificial
  20-mer unique DNA sequence
cattttacaagcccgcggag

SEQ ID NO: 2727 - DNA, 20 bp, Artificial
  20-mer unique DNA sequence
ttcagacccccacccaaccc

SEQ ID NO: 2728 - DNA, 20 bp, Artificial
  20-mer unique DNA sequence
catcgtgggccttccgggtc

SEQ ID NO: 2729 - DNA, 20 bp, Artificial
  20-mer unique DNA sequence
tatttgggcgctcaccggtt

SEQ ID NO: 2730 - DNA, 20 bp, Artificial
  20-mer unique DNA sequence
ttctggcggctcttgctggg

SEQ ID NO: 2731 - DNA, 20 bp, Artificial
  20-mer unique DNA sequence
ttgttgctctgcccaccgtc

SEQ ID NO: 2732 - DNA, 20 bp, Artificial
  20-mer unique DNA sequence
cgccaatcccaactcgccct

SEQ ID NO: 2733 - DNA, 20 bp, Artificial
  20-mer unique DNA sequence
cgaccgcttttatggcacgc

SEQ ID NO: 2734 - DNA, 20 bp, Artificial
  20-mer unique DNA sequence
actgggcgccaacttcgaat

SEQ ID NO: 2735 - DNA, 20 bp, Artificial
  20-mer unique DNA sequence
acccgtggagcccttgcttg

SEQ ID NO: 2736 - DNA, 20 bp, Artificial
  20-mer unique DNA sequence
aacccatcccgcgaacccag

SEQ ID NO: 2737 - DNA, 20 bp, Artificial
  20-mer unique DNA sequence
cgtgggatggcggatattgc

SEQ ID NO: 2738 - DNA, 20 bp, Artificial
  20-mer unique DNA sequence
ccccagcgacgtaccaagcc

SEQ ID NO: 2739 - DNA, 20 bp, Artificial
  20-mer unique DNA sequence
gcgggaggtgcaacgagatg

SEQ ID NO: 2740 - DNA, 20 bp, Artificial
  20-mer unique DNA sequence
ctgtggacgtgctgcggctc

SEQ ID NO: 2741 - DNA, 20 bp, Artificial
  20-mer unique DNA sequence
gggcggcactaggggaaatc

SEQ ID NO: 2742 - DNA, 20 bp, Artificial
  20-mer unique DNA sequence
tggtcggctttggaatcggg

SEQ ID NO: 2743 - DNA, 20 bp, Artificial
  20-mer unique DNA sequence
tggacacagggggccgagtt

SEQ ID NO: 2744 - DNA, 20 bp, Artificial
  20-mer unique DNA sequence
ttgcgacacaacccacaccc

SEQ ID NO: 2745 - DNA, 20 bp, Artificial
  20-mer unique DNA sequence
gccgggcgaagctgaaacct

SEQ ID NO: 2746 - DNA, 20 bp, Artificial
  20-mer unique DNA sequence
ccgccacgccacctattctc

SEQ ID NO: 2747 - DNA, 20 bp, Artificial
  20-mer unique DNA sequence
tctgtccccgtgctgccata

SEQ ID NO: 2748 - DNA, 20 bp, Artificial
  20-mer unique DNA sequence
aagcagggtaagcgggggag

SEQ ID NO: 2749 - DNA, 20 bp, Artificial
  20-mer unique DNA sequence
gaggtgcccaacatttccgc

SEQ ID NO: 2750 - DNA, 20 bp, Artificial
  20-mer unique DNA sequence
cgtaatgcgctcgccgaagt

SEQ ID NO: 2751 - DNA, 20 bp, Artificial
  20-mer unique DNA sequence
aatttgcccgccctactccg

SEQ ID NO: 2752 - DNA, 20 bp, Artificial
  20-mer unique DNA sequence
acagagcggggaccagggag

SEQ ID NO: 2753 - DNA, 20 bp, Artificial
  20-mer unique DNA sequence
ccagccaagcccgtagatgc

SEQ ID NO: 2754 - DNA, 20 bp, Artificial
  20-mer unique DNA sequence
ccccggatgagaaaaggcgt

SEQ ID NO: 2755 - DNA, 20 bp, Artificial
  20-mer unique DNA sequence
acttggcaggcgtcgggttg

SEQ ID NO: 2756 - DNA, 20 bp, Artificial
  20-mer unique DNA sequence
gggatgcggaatgggatggc

SEQ ID NO: 2757 - DNA, 20 bp, Artificial
  20-mer unique DNA sequence
aaacggaaaagcagcgggtg

SEQ ID NO: 2758 - DNA, 20 bp, Artificial
  20-mer unique DNA sequence
cggtatggggtggcttcgtg

SEQ ID NO: 2759 - DNA, 20 bp, Artificial
  20-mer unique DNA sequence
aatcctgttgctcggggtgc

SEQ ID NO: 2760 - DNA, 20 bp, Artificial
  20-mer unique DNA sequence
tcggatgcgccctcacccta

SEQ ID NO: 2761 - DNA, 20 bp, Artificial
  20-mer unique DNA sequence
tcgcaagccggtcccctaat

SEQ ID NO: 2762 - DNA, 20 bp, Artificial
  20-mer unique DNA sequence
gggcgggacttctcttggct

SEQ ID NO: 2763 - DNA, 20 bp, Artificial
  20-mer unique DNA sequence
agcaagcaagcaaagccgcc

SEQ ID NO: 2764 - DNA, 20 bp, Artificial
  20-mer unique DNA sequence
aggcgcggctgacttactca

SEQ ID NO: 2765 - DNA, 20 bp, Artificial
  20-mer unique DNA sequence
tgcggccagctgacgttcat

SEQ ID NO: 2766 - DNA, 20 bp, Artificial
  20-mer unique DNA sequence
tgtatgacccccgctcccga

SEQ ID NO: 2767 - DNA, 20 bp, Artificial
  20-mer unique DNA sequence
gagaattggtggacgggggg

SEQ ID NO: 2768 - DNA, 20 bp, Artificial
  20-mer unique DNA sequence
attcactgtccccccggctg

SEQ ID NO: 2769 - DNA, 20 bp, Artificial
  20-mer unique DNA sequence
tgcctagcacccctcgagcc

SEQ ID NO: 2770 - DNA, 20 bp, Artificial
  20-mer unique DNA sequence
agaacacggcagccagagcc

SEQ ID NO: 2771 - DNA, 20 bp, Artificial
  20-mer unique DNA sequence
ccggcccctcaagtgatcgt

SEQ ID NO: 2772 - DNA, 20 bp, Artificial
  20-mer unique DNA sequence
tcgtcccatccaacccctcc

SEQ ID NO: 2773 - DNA, 20 bp, Artificial
  20-mer unique DNA sequence
catcccggctcctcgtccgc

SEQ ID NO: 2774 - DNA, 20 bp, Artificial
  20-mer unique DNA sequence
agaagatgctggggtgggcg

SEQ ID NO: 2775 - DNA, 20 bp, Artificial
  20-mer unique DNA sequence
catcccgcttcgcccatctt

SEQ ID NO: 2776 - DNA, 20 bp, Artificial
  20-mer unique DNA sequence
ccgtcccgctcctctcactc

SEQ ID NO: 2777 - DNA, 20 bp, Artificial
  20-mer unique DNA sequence
cccacccaacggcacctaac

SEQ ID NO: 2778 - DNA, 20 bp, Artificial
  20-mer unique DNA sequence
agccccgaaaccacaccgta

SEQ ID NO: 2779 - DNA, 20 bp, Artificial
  20-mer unique DNA sequence
aacaacagcgaaccagcgcc

SEQ ID NO: 2780 - DNA, 20 bp, Artificial
  20-mer unique DNA sequence
caacaactgggcgccgataa

SEQ ID NO: 2781 - DNA, 20 bp, Artificial
  20-mer unique DNA sequence
cgcgcgggtttctccctaat

SEQ ID NO: 2782 - DNA, 20 bp, Artificial
  20-mer unique DNA sequence
cggttcggtcttcgtgcgtg

SEQ ID NO: 2783 - DNA, 20 bp, Artificial
  20-mer unique DNA sequence
cgcgtttcacatccttgggc

SEQ ID NO: 2784 - DNA, 20 bp, Artificial
  20-mer unique DNA sequence
tgagggatggaatggcggtg

SEQ ID NO: 2785 - DNA, 20 bp, Artificial
  20-mer unique DNA sequence
ttttggataccctcccccgg

SEQ ID NO: 2786 - DNA, 20 bp, Artificial
  20-mer unique DNA sequence
agcagtcggcggcattttgg

SEQ ID NO: 2787 - DNA, 20 bp, Artificial
  20-mer unique DNA sequence
atacccaggtcggtttcgcg

SEQ ID NO: 2788 - DNA, 20 bp, Artificial
  20-mer unique DNA sequence
tacagcgtggcacactcgtc

SEQ ID NO: 2789 - DNA, 20 bp, Artificial
  20-mer unique DNA sequence
agccagcgctagatctgcca

SEQ ID NO: 2790 - DNA, 20 bp, Artificial
  20-mer unique DNA sequence
cgtgccccattttcccagcc

SEQ ID NO: 2791 - DNA, 20 bp, Artificial
  20-mer unique DNA sequence
tgtgtcccgtccctttggcg

SEQ ID NO: 2792 - DNA, 20 bp, Artificial
  20-mer unique DNA sequence
gtggggcgactgctgttggt

SEQ ID NO: 2793 - DNA, 20 bp, Artificial
  20-mer unique DNA sequence
ggggcgtttgcaggggtagg

SEQ ID NO: 2794 - DNA, 20 bp, Artificial
  20-mer unique DNA sequence
tacctgggcgtgcactttcg

SEQ ID NO: 2795 - DNA, 20 bp, Artificial
  20-mer unique DNA sequence
tcagatcgcccctcaccagc

SEQ ID NO: 2796 - DNA, 20 bp, Artificial
  20-mer unique DNA sequence
cgcccaacccccctatcctt

SEQ ID NO: 2797 - DNA, 20 bp, Artificial
  20-mer unique DNA sequence
aggcgtggcgtgtggtctcg

SEQ ID NO: 2798 - DNA, 20 bp, Artificial
  20-mer unique DNA sequence
gtctgtcatcgcgggccctc

SEQ ID NO: 2799 - DNA, 20 bp, Artificial
  20-mer unique DNA sequence
gggcgccggcaaaacctata

SEQ ID NO: 2800 - DNA, 20 bp, Artificial
  20-mer unique DNA sequence
ccgacccgttaaggccaaag

SEQ ID NO: 2801 - DNA, 20 bp, Artificial
  20-mer unique DNA sequence
ccgacgtccacttaagcgca

SEQ ID NO: 2802 - DNA, 20 bp, Artificial
  20-mer unique DNA sequence
acggccagcctgactaacga

SEQ ID NO: 2803 - DNA, 20 bp, Artificial
  20-mer unique DNA sequence
cgccccaacgcaccactctt

SEQ ID NO: 2804 - DNA, 20 bp, Artificial
  20-mer unique DNA sequence
aggaggagaggcaaggcggg

SEQ ID NO: 2805 - DNA, 20 bp, Artificial
  20-mer unique DNA sequence
cacttgaacccaccccccca

SEQ ID NO: 2806 - DNA, 20 bp, Artificial
  20-mer unique DNA sequence
caggcgcccaggaaacacca

SEQ ID NO: 2807 - DNA, 20 bp, Artificial
  20-mer unique DNA sequence
acttgacatggaggccccgg

SEQ ID NO: 2808 - DNA, 20 bp, Artificial
  20-mer unique DNA sequence
ccataaagggctcccggcaa

SEQ ID NO: 2809 - DNA, 20 bp, Artificial
  20-mer unique DNA sequence
cggccgagccaatgtcaagt

SEQ ID NO: 2810 - DNA, 20 bp, Artificial
  20-mer unique DNA sequence
gcggggggctagtcatgagg

SEQ ID NO: 2811 - DNA, 20 bp, Artificial
  20-mer unique DNA sequence
ttgcacccagctcgtcgtcg

SEQ ID NO: 2812 - DNA, 20 bp, Artificial
  20-mer unique DNA sequence
cgcacatggggtctcggatt

SEQ ID NO: 2813 - DNA, 20 bp, Artificial
  20-mer unique DNA sequence
cgcccgcgataaagcgaaca

SEQ ID NO: 2814 - DNA, 20 bp, Artificial
  20-mer unique DNA sequence
cgcccgatttacggtcacgt

SEQ ID NO: 2815 - DNA, 20 bp, Artificial
  20-mer unique DNA sequence
cacccccgtacgcaaccact

SEQ ID NO: 2816 - DNA, 20 bp, Artificial
  20-mer unique DNA sequence
aatggacccacacccttcgg

SEQ ID NO: 2817 - DNA, 20 bp, Artificial
  20-mer unique DNA sequence
cccgtgtcgcctgaggtgtc

SEQ ID NO: 2818 - DNA, 20 bp, Artificial
  20-mer unique DNA sequence
tacgcacccctcgccttacc

SEQ ID NO: 2819 - DNA, 20 bp, Artificial
  20-mer unique DNA sequence
ggcgggtgtcaagggagcgt

SEQ ID NO: 2820 - DNA, 20 bp, Artificial
  20-mer unique DNA sequence
tgtcttcctccccccatgtc

SEQ ID NO: 2821 - DNA, 20 bp, Artificial
  20-mer unique DNA sequence
gcgcgatgaagggagggaag

SEQ ID NO: 2822 - DNA, 20 bp, Artificial
  20-mer unique DNA sequence
aaatgccgtagggcgagggg

SEQ ID NO: 2823 - DNA, 20 bp, Artificial
  20-mer unique DNA sequence
gagcctttgttcccccccga

SEQ ID NO: 2824 - DNA, 20 bp, Artificial
  20-mer unique DNA sequence
tggtgttggtcggcgctttt

SEQ ID NO: 2825 - DNA, 20 bp, Artificial
  20-mer unique DNA sequence
atgctcgcgcttttctccca

SEQ ID NO: 2826 - DNA, 20 bp, Artificial
  20-mer unique DNA sequence
accaaaccaaggccacccaa

SEQ ID NO: 2827 - DNA, 20 bp, Artificial
  20-mer unique DNA sequence
acgatgaaggggcggggact

SEQ ID NO: 2828 - DNA, 20 bp, Artificial
  20-mer unique DNA sequence
ccagccgccagcacaaatcc

SEQ ID NO: 2829 - DNA, 20 bp, Artificial
  20-mer unique DNA sequence
ctccgcacctcgcctcagaa

SEQ ID NO: 2830 - DNA, 20 bp, Artificial
  20-mer unique DNA sequence
tacctggcgccttgaatccg

SEQ ID NO: 2831 - DNA, 20 bp, Artificial
  20-mer unique DNA sequence
gaccaacctcagcccgctac

SEQ ID NO: 2832 - DNA, 20 bp, Artificial
  20-mer unique DNA sequence
ccgctcgtccctctttcctg

SEQ ID NO: 2833 - DNA, 20 bp, Artificial
  20-mer unique DNA sequence
tgcagccacaaacccaagcg

SEQ ID NO: 2834 - DNA, 20 bp, Artificial
  20-mer unique DNA sequence
atacaagatccggccgtggg

SEQ ID NO: 2835 - DNA, 20 bp, Artificial
  20-mer unique DNA sequence
gtggcggttgttcttgcgtg

SEQ ID NO: 2836 - DNA, 20 bp, Artificial
  20-mer unique DNA sequence
tcggatgtaagcgttggccc

SEQ ID NO: 2837 - DNA, 20 bp, Artificial
  20-mer unique DNA sequence
gccattctgcccggactcac

SEQ ID NO: 2838 - DNA, 20 bp, Artificial
  20-mer unique DNA sequence
tcccgtcatagcccttcccg

SEQ ID NO: 2839 - DNA, 20 bp, Artificial
  20-mer unique DNA sequence
aatgggcggggagtagggga

SEQ ID NO: 2840 - DNA, 20 bp, Artificial
  20-mer unique DNA sequence
ccgttgccgtgtgtatgcgt

SEQ ID NO: 2841 - DNA, 20 bp, Artificial
  20-mer unique DNA sequence
tgcttgcggcgacggtaggt

SEQ ID NO: 2842 - DNA, 20 bp, Artificial
  20-mer unique DNA sequence
aaatccgcctcctcccccta

SEQ ID NO: 2843 - DNA, 20 bp, Artificial
  20-mer unique DNA sequence
agggggattagcggtgcagg

SEQ ID NO: 2844 - DNA, 20 bp, Artificial
  20-mer unique DNA sequence
gcgctgcaccccgacaaatc

SEQ ID NO: 2845 - DNA, 20 bp, Artificial
  20-mer unique DNA sequence
tgctctccgtccttacccgc

SEQ ID NO: 2846 - DNA, 20 bp, Artificial
  20-mer unique DNA sequence
agttggggcagcgtggtgaa

SEQ ID NO: 2847 - DNA, 20 bp, Artificial
  20-mer unique DNA sequence
taggggatattcggacgcgg

SEQ ID NO: 2848 - DNA, 20 bp, Artificial
  20-mer unique DNA sequence
caatcctccaccaccacgca

SEQ ID NO: 2849 - DNA, 20 bp, Artificial
  20-mer unique DNA sequence
cggggcggcaatcgataaaa

SEQ ID NO: 2850 - DNA, 20 bp, Artificial
  20-mer unique DNA sequence
acccctctgcaccaatgccg

SEQ ID NO: 2851 - DNA, 20 bp, Artificial
  20-mer unique DNA sequence
atgcccaaagaccgcccctg

SEQ ID NO: 2852 - DNA, 20 bp, Artificial
  20-mer unique DNA sequence
tgaccccgctttgttgagcc

SEQ ID NO: 2853 - DNA, 20 bp, Artificial
  20-mer unique DNA sequence
ggcataactcaggggcagcg

SEQ ID NO: 2854 - DNA, 20 bp, Artificial
  20-mer unique DNA sequence
gctgcgggggattggaggac

SEQ ID NO: 2855 - DNA, 20 bp, Artificial
  20-mer unique DNA sequence
tctcgtggttggtgcgtgcc

SEQ ID NO: 2856 - DNA, 20 bp, Artificial
  20-mer unique DNA sequence
cgcgatgttacggggctacg

SEQ ID NO: 2857 - DNA, 20 bp, Artificial
  20-mer unique DNA sequence
cccgcgtgtctgctgcaata

SEQ ID NO: 2858 - DNA, 20 bp, Artificial
  20-mer unique DNA sequence
ctgggctcgttgcgtgatca

SEQ ID NO: 2859 - DNA, 20 bp, Artificial
  20-mer unique DNA sequence
acatcaagggcgcgacaggt

SEQ ID NO: 2860 - DNA, 20 bp, Artificial
  20-mer unique DNA sequence
aagtgtgggctcgtgggggg

SEQ ID NO: 2861 - DNA, 20 bp, Artificial
  20-mer unique DNA sequence
aaatgagcggttgcggtcgt

SEQ ID NO: 2862 - DNA, 20 bp, Artificial
  20-mer unique DNA sequence
taaatcggggcttcacggct

SEQ ID NO: 2863 - DNA, 20 bp, Artificial
  20-mer unique DNA sequence
acgcaccaactccgccgaat

SEQ ID NO: 2864 - DNA, 20 bp, Artificial
  20-mer unique DNA sequence
tcacttcgcccacttccgct

SEQ ID NO: 2865 - DNA, 20 bp, Artificial
  20-mer unique DNA sequence
tacctgttctgtccccgcgc

SEQ ID NO: 2866 - DNA, 20 bp, Artificial
  20-mer unique DNA sequence
acgggcggtggtgatttgct

SEQ ID NO: 2867 - DNA, 20 bp, Artificial
  20-mer unique DNA sequence
aaatgctgggggtcgtggct

SEQ ID NO: 2868 - DNA, 20 bp, Artificial
  20-mer unique DNA sequence
caacaggggcgtacgggcag

SEQ ID NO: 2869 - DNA, 20 bp, Artificial
  20-mer unique DNA sequence
gtctgggtggtgcgtgtcgc

SEQ ID NO: 2870 - DNA, 20 bp, Artificial
  20-mer unique DNA sequence
ttcttacccgcctgtcccga

SEQ ID NO: 2871 - DNA, 20 bp, Artificial
  20-mer unique DNA sequence
cgctattgccttggatccga

SEQ ID NO: 2872 - DNA, 20 bp, Artificial
  20-mer unique DNA sequence
cagggggaggtcgtatggcc

SEQ ID NO: 2873 - DNA, 20 bp, Artificial
  20-mer unique DNA sequence
attgggtacggcgcagggtt

SEQ ID NO: 2874 - DNA, 20 bp, Artificial
  20-mer unique DNA sequence
tttgttttcgggtgcggatg

SEQ ID NO: 2875 - DNA, 20 bp, Artificial
  20-mer unique DNA sequence
caccaccaaccgcgccatag

SEQ ID NO: 2876 - DNA, 20 bp, Artificial
  20-mer unique DNA sequence
actgggaacgcaaggcgggt

SEQ ID NO: 2877 - DNA, 20 bp, Artificial
  20-mer unique DNA sequence
attccctccctctgccgggt

SEQ ID NO: 2878 - DNA, 20 bp, Artificial
  20-mer unique DNA sequence
atcgcggcatatacccctgc

SEQ ID NO: 2879 - DNA, 20 bp, Artificial
  20-mer unique DNA sequence
gaaattgcgacctggcggtg

SEQ ID NO: 2880 - DNA, 20 bp, Artificial
  20-mer unique DNA sequence
acaccacgctccttcgcaaa

SEQ ID NO: 2881 - DNA, 20 bp, Artificial
  20-mer unique DNA sequence
cgtacaaatggggggggaca

SEQ ID NO: 2882 - DNA, 20 bp, Artificial
  20-mer unique DNA sequence
cgcggcacattccacccttc

SEQ ID NO: 2883 - DNA, 20 bp, Artificial
  20-mer unique DNA sequence
acttcattcctgcatcgggg

SEQ ID NO: 2884 - DNA, 20 bp, Artificial
  20-mer unique DNA sequence
cagtgccctccgttgaccgt

SEQ ID NO: 2885 - DNA, 20 bp, Artificial
  20-mer unique DNA sequence
cgtgggcaggacagaagcag

SEQ ID NO: 2886 - DNA, 20 bp, Artificial
  20-mer unique DNA sequence
tttgtccggtctttcgcgcg

SEQ ID NO: 2887 - DNA, 20 bp, Artificial
  20-mer unique DNA sequence
ggctcccgcttcgcttattg

SEQ ID NO: 2888 - DNA, 20 bp, Artificial
  20-mer unique DNA sequence
tgggaaacgtggtggggtga

SEQ ID NO: 2889 - DNA, 20 bp, Artificial
  20-mer unique DNA sequence
cccttggctgtttcggttcc

SEQ ID NO: 2890 - DNA, 20 bp, Artificial
  20-mer unique DNA sequence
agacacttggcccaggacag

SEQ ID NO: 2891 - DNA, 20 bp, Artificial
  20-mer unique DNA sequence
gtatgccgctaacgccgaga

SEQ ID NO: 2892 - DNA, 20 bp, Artificial
  20-mer unique DNA sequence
agttaggcttggcgttggcg

SEQ ID NO: 2893 - DNA, 20 bp, Artificial
  20-mer unique DNA sequence
atgcggccggaatttgtgtg

SEQ ID NO: 2894 - DNA, 20 bp, Artificial
  20-mer unique DNA sequence
ccaggggcaacgattaaggc

SEQ ID NO: 2895 - DNA, 20 bp, Artificial
  20-mer unique DNA sequence
cgttccgtgcgcttcctatg

SEQ ID NO: 2896 - DNA, 20 bp, Artificial
  20-mer unique DNA sequence
actatcacaaagcggcggca

SEQ ID NO: 2897 - DNA, 20 bp, Artificial
  20-mer unique DNA sequence
ccgcagcaccccaacactct

SEQ ID NO: 2898 - DNA, 20 bp, Artificial
  20-mer unique DNA sequence
gtgcggtctttggcaggcag

SEQ ID NO: 2899 - DNA, 20 bp, Artificial
  20-mer unique DNA sequence
agacgcccgttgcggattga

SEQ ID NO: 2900 - DNA, 20 bp, Artificial
  20-mer unique DNA sequence
cgagcgcgatcaaccgagaa

SEQ ID NO: 2901 - DNA, 20 bp, Artificial
  20-mer unique DNA sequence
cgttctgcctcccaccacct

SEQ ID NO: 2902 - DNA, 20 bp, Artificial
  20-mer unique DNA sequence
tgacatgtaccgcgaggccg

SEQ ID NO: 2903 - DNA, 20 bp, Artificial
  20-mer unique DNA sequence
tccctgagcccacaaaccct

SEQ ID NO: 2904 - DNA, 20 bp, Artificial
  20-mer unique DNA sequence
ggttgcccaggctgattcga

SEQ ID NO: 2905 - DNA, 20 bp, Artificial
  20-mer unique DNA sequence
gtgccgttgtggggccctct

SEQ ID NO: 2906 - DNA, 20 bp, Artificial
  20-mer unique DNA sequence
cagcctcccgccttcacgac

SEQ ID NO: 2907 - DNA, 20 bp, Artificial
  20-mer unique DNA sequence
gcttcagcgactcggatcgt

SEQ ID NO: 2908 - DNA, 20 bp, Artificial
  20-mer unique DNA sequence
cgggtcaaaactgggggcaa

SEQ ID NO: 2909 - DNA, 20 bp, Artificial
  20-mer unique DNA sequence
aaaatctaccatgggccgcg

SEQ ID NO: 2910 - DNA, 20 bp, Artificial
  20-mer unique DNA sequence
tccccggaagtttggagccc

SEQ ID NO: 2911 - DNA, 20 bp, Artificial
  20-mer unique DNA sequence
accgggagggcttgggattc

SEQ ID NO: 2912 - DNA, 20 bp, Artificial
  20-mer unique DNA sequence
ccacggacgtagtccgcaat

SEQ ID NO: 2913 - DNA, 20 bp, Artificial
  20-mer unique DNA sequence
gattttagcgcgcgtccatg

SEQ ID NO: 2914 - DNA, 20 bp, Artificial
  20-mer unique DNA sequence
gtaggcatttgggaggcgag

SEQ ID NO: 2915 - DNA, 20 bp, Artificial
  20-mer unique DNA sequence
atgacccacaccctgccccc

SEQ ID NO: 2916 - DNA, 20 bp, Artificial
  20-mer unique DNA sequence
tctcacaagggctcacgcga

SEQ ID NO: 2917 - DNA, 20 bp, Artificial
  20-mer unique DNA sequence
gccttccagcagtccggtcc

SEQ ID NO: 2918 - DNA, 20 bp, Artificial
  20-mer unique DNA sequence
gcctggtggcgcgtttttca

SEQ ID NO: 2919 - DNA, 20 bp, Artificial
  20-mer unique DNA sequence
tcaaggggtgcgcgggtaga

SEQ ID NO: 2920 - DNA, 20 bp, Artificial
  20-mer unique DNA sequence
ctacacggtcacaggcgcat

SEQ ID NO: 2921 - DNA, 20 bp, Artificial
  20-mer unique DNA sequence
tggcgtggctctcaaatgga

SEQ ID NO: 2922 - DNA, 20 bp, Artificial
  20-mer unique DNA sequence
tcagccaccccaagcccatc

SEQ ID NO: 2923 - DNA, 20 bp, Artificial
  20-mer unique DNA sequence
agggtggtggcgacgaacaa

SEQ ID NO: 2924 - DNA, 20 bp, Artificial
  20-mer unique DNA sequence
gtgctgcggcggaagaaaag

SEQ ID NO: 2925 - DNA, 20 bp, Artificial
  20-mer unique DNA sequence
tttccacgccggacccagac

SEQ ID NO: 2926 - DNA, 20 bp, Artificial
  20-mer unique DNA sequence
cgtgccacccaatgacaact

SEQ ID NO: 2927 - DNA, 20 bp, Artificial
  20-mer unique DNA sequence
gcctgtgtgttcggggatcg

SEQ ID NO: 2928 - DNA, 20 bp, Artificial
  20-mer unique DNA sequence
cggttgggaagttgggtgcc

SEQ ID NO: 2929 - DNA, 20 bp, Artificial
  20-mer unique DNA sequence
agatactctcttcggccgcg

SEQ ID NO: 2930 - DNA, 20 bp, Artificial
  20-mer unique DNA sequence
aaatgtcgagcggaggggtg

SEQ ID NO: 2931 - DNA, 20 bp, Artificial
  20-mer unique DNA sequence
cagccgggacgaatggaaac

SEQ ID NO: 2932 - DNA, 20 bp, Artificial
  20-mer unique DNA sequence
tttcccgccaccttccagtc

SEQ ID NO: 2933 - DNA, 20 bp, Artificial
  20-mer unique DNA sequence
ggggggctttccagtggggt

SEQ ID NO: 2934 - DNA, 20 bp, Artificial
  20-mer unique DNA sequence
accaacaccgccccgtaaac

SEQ ID NO: 2935 - DNA, 20 bp, Artificial
  20-mer unique DNA sequence
ccacccacatcgcctctcgt

SEQ ID NO: 2936 - DNA, 20 bp, Artificial
  20-mer unique DNA sequence
gctcctgactgtacgcgaga

SEQ ID NO: 2937 - DNA, 20 bp, Artificial
  20-mer unique DNA sequence
gctggaaaatccgttgcccg

SEQ ID NO: 2938 - DNA, 20 bp, Artificial
  20-mer unique DNA sequence
gaactgccaatgcccctcgg

SEQ ID NO: 2939 - DNA, 20 bp, Artificial
  20-mer unique DNA sequence
cgagctcctctcactgggcg

SEQ ID NO: 2940 - DNA, 20 bp, Artificial
  20-mer unique DNA sequence
cctagaacccatgcgcctcg

SEQ ID NO: 2941 - DNA, 20 bp, Artificial
  20-mer unique DNA sequence
tgcggggatttgcaacggta

SEQ ID NO: 2942 - DNA, 20 bp, Artificial
  20-mer unique DNA sequence
ttacacgtccgcggggccaa

SEQ ID NO: 2943 - DNA, 20 bp, Artificial
  20-mer unique DNA sequence
gtgatgttgggagcacgcgc

SEQ ID NO: 2944 - DNA, 20 bp, Artificial
  20-mer unique DNA sequence
agaagcgagggggacagcgg

SEQ ID NO: 2945 - DNA, 20 bp, Artificial
  20-mer unique DNA sequence
ggctagcggaaggccaggtc

SEQ ID NO: 2946 - DNA, 20 bp, Artificial
  20-mer unique DNA sequence
gctggcggtttaaagggctg

SEQ ID NO: 2947 - DNA, 20 bp, Artificial
  20-mer unique DNA sequence
ttaactatggacgggggcgg

SEQ ID NO: 2948 - DNA, 20 bp, Artificial
  20-mer unique DNA sequence
tgagcggccggaggttatgg

SEQ ID NO: 2949 - DNA, 20 bp, Artificial
  20-mer unique DNA sequence
gtacgaatcccaacccggcg

SEQ ID NO: 2950 - DNA, 20 bp, Artificial
  20-mer unique DNA sequence
ctcatcccgccccattgctt

SEQ ID NO: 2951 - DNA, 20 bp, Artificial
  20-mer unique DNA sequence
gcgggggggtaatcaaatgg

SEQ ID NO: 2952 - DNA, 20 bp, Artificial
  20-mer unique DNA sequence
cacgcgtccccacccttctg

SEQ ID NO: 2953 - DNA, 20 bp, Artificial
  20-mer unique DNA sequence
tcggttcagggagcagggtt

SEQ ID NO: 2954 - DNA, 20 bp, Artificial
  20-mer unique DNA sequence
cgcgaatgacgggactacca

SEQ ID NO: 2955 - DNA, 20 bp, Artificial
  20-mer unique DNA sequence
tgaactcttagcgtgccccg

SEQ ID NO: 2956 - DNA, 20 bp, Artificial
  20-mer unique DNA sequence
tgggcggtgggcgaataaga

SEQ ID NO: 2957 - DNA, 20 bp, Artificial
  20-mer unique DNA sequence
cctctcttgcttcgcctccg

SEQ ID NO: 2958 - DNA, 20 bp, Artificial
  20-mer unique DNA sequence
gggggccgcgatagtcactg

SEQ ID NO: 2959 - DNA, 20 bp, Artificial
  20-mer unique DNA sequence
gttaacggccactccgccca

SEQ ID NO: 2960 - DNA, 20 bp, Artificial
  20-mer unique DNA sequence
aagggccgcggtgtttgtaa

SEQ ID NO: 2961 - DNA, 20 bp, Artificial
  20-mer unique DNA sequence
gagccaaccccacgaccaag

SEQ ID NO: 2962 - DNA, 20 bp, Artificial
  20-mer unique DNA sequence
ggcggccgtgagaggaagag

SEQ ID NO: 2963 - DNA, 20 bp, Artificial
  20-mer unique DNA sequence
cagtcgagggcggggatttc

SEQ ID NO: 2964 - DNA, 20 bp, Artificial
  20-mer unique DNA sequence
cacagtccccgatccagcaa

SEQ ID NO: 2965 - DNA, 20 bp, Artificial
  20-mer unique DNA sequence
gacaggttcaggccagcggt

SEQ ID NO: 2966 - DNA, 20 bp, Artificial
  20-mer unique DNA sequence
tgcgacccgcgatctactgt

SEQ ID NO: 2967 - DNA, 20 bp, Artificial
  20-mer unique DNA sequence
atgccgcctacggacgtaca

SEQ ID NO: 2968 - DNA, 20 bp, Artificial
  20-mer unique DNA sequence
gcgccctagtacgtgtccat

SEQ ID NO: 2969 - DNA, 20 bp, Artificial
  20-mer unique DNA sequence
acgactaccagaggcccgat

SEQ ID NO: 2970 - DNA, 20 bp, Artificial
  20-mer unique DNA sequence
gggccagtcccacgtttaca

SEQ ID NO: 2971 - DNA, 20 bp, Artificial
  20-mer unique DNA sequence
aggcgaagggcgatttgagc

SEQ ID NO: 2972 - DNA, 20 bp, Artificial
  20-mer unique DNA sequence
ggccccacccaactcgctgt

SEQ ID NO: 2973 - DNA, 20 bp, Artificial
  20-mer unique DNA sequence
tgcaggtcttgggggtcgtc

SEQ ID NO: 2974 - DNA, 20 bp, Artificial
  20-mer unique DNA sequence
tggctggatttggttcggga

SEQ ID NO: 2975 - DNA, 20 bp, Artificial
  20-mer unique DNA sequence
ctgttcccactcgcccctcg

SEQ ID NO: 2976 - DNA, 20 bp, Artificial
  20-mer unique DNA sequence
cattgcctaggctgcggaca

SEQ ID NO: 2977 - DNA, 20 bp, Artificial
  20-mer unique DNA sequence
cgtggatgcggggaaacgac

SEQ ID NO: 2978 - DNA, 20 bp, Artificial
  20-mer unique DNA sequence
gaaccccaccccagcgaaat

SEQ ID NO: 2979 - DNA, 20 bp, Artificial
  20-mer unique DNA sequence
cgcttgagtgcccgatggag

SEQ ID NO: 2980 - DNA, 20 bp, Artificial
  20-mer unique DNA sequence
cgcccaataggtcttcgccc

SEQ ID NO: 2981 - DNA, 20 bp, Artificial
  20-mer unique DNA sequence
ccacgcgtctgtaatccccg

SEQ ID NO: 2982 - DNA, 20 bp, Artificial
  20-mer unique DNA sequence
tgattctcgggctggtgtgc

SEQ ID NO: 2983 - DNA, 20 bp, Artificial
  20-mer unique DNA sequence
tgtctcgtcatcccacccgc

SEQ ID NO: 2984 - DNA, 20 bp, Artificial
  20-mer unique DNA sequence
ctggggacaaccgaaggcga

SEQ ID NO: 2985 - DNA, 20 bp, Artificial
  20-mer unique DNA sequence
agctggggccttgtcacgtg

SEQ ID NO: 2986 - DNA, 20 bp, Artificial
  20-mer unique DNA sequence
cagcacccccatcccctttg

SEQ ID NO: 2987 - DNA, 20 bp, Artificial
  20-mer unique DNA sequence
tggatggcgctatggtgtgg

SEQ ID NO: 2988 - DNA, 20 bp, Artificial
  20-mer unique DNA sequence
atcgtcgctcaccctctcgg

SEQ ID NO: 2989 - DNA, 20 bp, Artificial
  20-mer unique DNA sequence
cctttccttccatcgcgcag

SEQ ID NO: 2990 - DNA, 20 bp, Artificial
  20-mer unique DNA sequence
atgacagaagcggcaggcaa

SEQ ID NO: 2991 - DNA, 20 bp, Artificial
  20-mer unique DNA sequence
tgcccttcactttgtcgccc

SEQ ID NO: 2992 - DNA, 20 bp, Artificial
  20-mer unique DNA sequence
tggcagtcgggggctaaaaa

SEQ ID NO: 2993 - DNA, 20 bp, Artificial
  20-mer unique DNA sequence
ggggggagatcggcatggag

SEQ ID NO: 2994 - DNA, 20 bp, Artificial
  20-mer unique DNA sequence
gccaatccaccgcagacatg

SEQ ID NO: 2995 - DNA, 20 bp, Artificial
  20-mer unique DNA sequence
cacccgcgctcgatcataaa

SEQ ID NO: 2996 - DNA, 20 bp, Artificial
  20-mer unique DNA sequence
cgtggttcctcgtgctcgcc

SEQ ID NO: 2997 - DNA, 20 bp, Artificial
  20-mer unique DNA sequence
ctcttccgtccagttcgccg

SEQ ID NO: 2998 - DNA, 20 bp, Artificial
  20-mer unique DNA sequence
taaggtcgagacgcgggttg

SEQ ID NO: 2999 - DNA, 20 bp, Artificial
  20-mer unique DNA sequence
ggtgccgatcagtgcctgtt

SEQ ID NO: 3000 - DNA, 20 bp, Artificial
  20-mer unique DNA sequence
ccctactatgcccgccattg

SEQ ID NO: 3001 - DNA, 20 bp, Artificial
  20-mer unique DNA sequence
tcgcaatcgggaaatcgtcc

SEQ ID NO: 3002 - DNA, 20 bp, Artificial
  20-mer unique DNA sequence
accatcgcgccttcacaaaa

SEQ ID NO: 3003 - DNA, 20 bp, Artificial
  20-mer unique DNA sequence
cgtcgttttgcgcccctagc

SEQ ID NO: 3004 - DNA, 20 bp, Artificial
  20-mer unique DNA sequence
aatcaggttcccagggcgac

SEQ ID NO: 3005 - DNA, 20 bp, Artificial
  20-mer unique DNA sequence
tgcctgtcggatggtcactc

SEQ ID NO: 3006 - DNA, 20 bp, Artificial
  20-mer unique DNA sequence
cccggtaccccctgcaaatg

SEQ ID NO: 3007 - DNA, 20 bp, Artificial
  20-mer unique DNA sequence
attctcccgccgtccaacaa

SEQ ID NO: 3008 - DNA, 20 bp, Artificial
  20-mer unique DNA sequence
ctatggattgcggtcgagcc

SEQ ID NO: 3009 - DNA, 20 bp, Artificial
  20-mer unique DNA sequence
ctttttcgaccccaccgctc

SEQ ID NO: 3010 - DNA, 20 bp, Artificial
  20-mer unique DNA sequence
gctgaacaataaccccgccg

SEQ ID NO: 3011 - DNA, 20 bp, Artificial
  20-mer unique DNA sequence
ggagaagggatcggaacggc

SEQ ID NO: 3012 - DNA, 20 bp, Artificial
  20-mer unique DNA sequence
tagctccatccgccactgca

SEQ ID NO: 3013 - DNA, 20 bp, Artificial
  20-mer unique DNA sequence
tgcagccacgatagaccgcc

SEQ ID NO: 3014 - DNA, 20 bp, Artificial
  20-mer unique DNA sequence
gcatgcgccggtaagctcgt

SEQ ID NO: 3015 - DNA, 20 bp, Artificial
  20-mer unique DNA sequence
acgaaagcgccagcaacagg

SEQ ID NO: 3016 - DNA, 20 bp, Artificial
  20-mer unique DNA sequence
ccaccagcagcagttccccg

SEQ ID NO: 3017 - DNA, 20 bp, Artificial
  20-mer unique DNA sequence
cccgcaaactcaccccctgt

SEQ ID NO: 3018 - DNA, 20 bp, Artificial
  20-mer unique DNA sequence
accctaggcgttagcgtggt

SEQ ID NO: 3019 - DNA, 20 bp, Artificial
  20-mer unique DNA sequence
cgtgatcgccgactaaggct

SEQ ID NO: 3020 - DNA, 20 bp, Artificial
  20-mer unique DNA sequence
cacaccagccctccaaccgt

SEQ ID NO: 3021 - DNA, 20 bp, Artificial
  20-mer unique DNA sequence
cttccgacccgacaaccctc

SEQ ID NO: 3022 - DNA, 20 bp, Artificial
  20-mer unique DNA sequence
ccggtgagggactggctgag

SEQ ID NO: 3023 - DNA, 20 bp, Artificial
  20-mer unique DNA sequence
atccacgcgtcaccaaaggc

SEQ ID NO: 3024 - DNA, 20 bp, Artificial
  20-mer unique DNA sequence
ccctatgaccccaccgcctt

SEQ ID NO: 3025 - DNA, 20 bp, Artificial
  20-mer unique DNA sequence
gccgaacctccacaaccagg

SEQ ID NO: 3026 - DNA, 20 bp, Artificial
  20-mer unique DNA sequence
tggaggtgcccgggaaggag

SEQ ID NO: 3027 - DNA, 20 bp, Artificial
  20-mer unique DNA sequence
tccgatgagcggcgaacaat

SEQ ID NO: 3028 - DNA, 20 bp, Artificial
  20-mer unique DNA sequence
taatggtgttgccccgtgcg

SEQ ID NO: 3029 - DNA, 20 bp, Artificial
  20-mer unique DNA sequence
atgctgtgcgcgggttattg

SEQ ID NO: 3030 - DNA, 20 bp, Artificial
  20-mer unique DNA sequence
agggcgtgttgtcgggatct

SEQ ID NO: 3031 - DNA, 20 bp, Artificial
  20-mer unique DNA sequence
caccacctcgcgaacaaccg

SEQ ID NO: 3032 - DNA, 20 bp, Artificial
  20-mer unique DNA sequence
ggggtttgacggggcgaagt

SEQ ID NO: 3033 - DNA, 20 bp, Artificial
  20-mer unique DNA sequence
ttccgctttgtccgctcctg

SEQ ID NO: 3034 - DNA, 20 bp, Artificial
  20-mer unique DNA sequence
ccacccccgtcgctcatcct

SEQ ID NO: 3035 - DNA, 20 bp, Artificial
  20-mer unique DNA sequence
gacgatccggagtgggcaaa

SEQ ID NO: 3036 - DNA, 20 bp, Artificial
  20-mer unique DNA sequence
accgcgatagccatttcccc

SEQ ID NO: 3037 - DNA, 20 bp, Artificial
  20-mer unique DNA sequence
ttcatcaaactctccgcgcg

SEQ ID NO: 3038 - DNA, 20 bp, Artificial
  20-mer unique DNA sequence
tcgcgggggtgggtctttta

SEQ ID NO: 3039 - DNA, 20 bp, Artificial
  20-mer unique DNA sequence
gtctttggttcccccgctcg

SEQ ID NO: 3040 - DNA, 20 bp, Artificial
  20-mer unique DNA sequence
tcagcaagcccgcaacgtac

SEQ ID NO: 3041 - DNA, 20 bp, Artificial
  20-mer unique DNA sequence
tgtccttcccggtgtgcctc

SEQ ID NO: 3042 - DNA, 20 bp, Artificial
  20-mer unique DNA sequence
gttgcggccagcgtatgaaa

SEQ ID NO: 3043 - DNA, 20 bp, Artificial
  20-mer unique DNA sequence
gttctcaccccggcatttgg

SEQ ID NO: 3044 - DNA, 20 bp, Artificial
  20-mer unique DNA sequence
cacgtgctatctcaccggga

SEQ ID NO: 3045 - DNA, 20 bp, Artificial
  20-mer unique DNA sequence
acacgtacgagccacgaagc

SEQ ID NO: 3046 - DNA, 20 bp, Artificial
  20-mer unique DNA sequence
cgggtaggagcggatgatgg

SEQ ID NO: 3047 - DNA, 20 bp, Artificial
  20-mer unique DNA sequence
acagtactcgccgcgcccac

SEQ ID NO: 3048 - DNA, 20 bp, Artificial
  20-mer unique DNA sequence
aaaggccgcaccgcaagaaa

SEQ ID NO: 3049 - DNA, 20 bp, Artificial
  20-mer unique DNA sequence
cctggctcctctcctgcttg

SEQ ID NO: 3050 - DNA, 20 bp, Artificial
  20-mer unique DNA sequence
gcccgaaagcgcaggatcag

SEQ ID NO: 3051 - DNA, 20 bp, Artificial
  20-mer unique DNA sequence
ccattgaatttccggcgggg

SEQ ID NO: 3052 - DNA, 20 bp, Artificial
  20-mer unique DNA sequence
tccaacatctcccgcccagg

SEQ ID NO: 3053 - DNA, 20 bp, Artificial
  20-mer unique DNA sequence
gtgtatgggagagggcggta

SEQ ID NO: 3054 - DNA, 20 bp, Artificial
  20-mer unique DNA sequence
ggtgtagaggcgggtgcgga

SEQ ID NO: 3055 - DNA, 20 bp, Artificial
  20-mer unique DNA sequence
ggcggggcaagaagaggttg

SEQ ID NO: 3056 - DNA, 20 bp, Artificial
  20-mer unique DNA sequence
tcagggcgggagaatcgaat

SEQ ID NO: 3057 - DNA, 20 bp, Artificial
  20-mer unique DNA sequence
aatccgccccgcaaacagac

SEQ ID NO: 3058 - DNA, 20 bp, Artificial
  20-mer unique DNA sequence
tccgagcggtccacagaacg

SEQ ID NO: 3059 - DNA, 20 bp, Artificial
  20-mer unique DNA sequence
cgaactcaccacgctgccga

SEQ ID NO: 3060 - DNA, 20 bp, Artificial
  20-mer unique DNA sequence
ggaaaagctcagtgccgggg

SEQ ID NO: 3061 - DNA, 20 bp, Artificial
  20-mer unique DNA sequence
catcgcctcccacacccttg

SEQ ID NO: 3062 - DNA, 20 bp, Artificial
  20-mer unique DNA sequence
aatgtcccgccccctaaagc

SEQ ID NO: 3063 - DNA, 20 bp, Artificial
  20-mer unique DNA sequence
cgacgccacaacttccacga

SEQ ID NO: 3064 - DNA, 20 bp, Artificial
  20-mer unique DNA sequence
gtgtctaccccgctgccggt

SEQ ID NO: 3065 - DNA, 20 bp, Artificial
  20-mer unique DNA sequence
gagccggtgttcgggggtat

SEQ ID NO: 3066 - DNA, 20 bp, Artificial
  20-mer unique DNA sequence
aatttccgctatggccccgt

SEQ ID NO: 3067 - DNA, 20 bp, Artificial
  20-mer unique DNA sequence
agggccagagcgacgtagca

SEQ ID NO: 3068 - DNA, 20 bp, Artificial
  20-mer unique DNA sequence
cgaggcggacgtggtggtct

SEQ ID NO: 3069 - DNA, 20 bp, Artificial
  20-mer unique DNA sequence
catacaagcacgcgcctcga

SEQ ID NO: 3070 - DNA, 20 bp, Artificial
  20-mer unique DNA sequence
cttccactccgcatcacccc

SEQ ID NO: 3071 - DNA, 20 bp, Artificial
  20-mer unique DNA sequence
tacggatcgcggggaacaaa

SEQ ID NO: 3072 - DNA, 20 bp, Artificial
  20-mer unique DNA sequence
gggccgaggattgcatgagt

SEQ ID NO: 3073 - DNA, 20 bp, Artificial
  20-mer unique DNA sequence
acatcaacttgccgtcgggg

SEQ ID NO: 3074 - DNA, 20 bp, Artificial
  20-mer unique DNA sequence
aggtcgtgcgggtatggggg

SEQ ID NO: 3075 - DNA, 20 bp, Artificial
  20-mer unique DNA sequence
agttgcggcggttgatgagc

SEQ ID NO: 3076 - DNA, 20 bp, Artificial
  20-mer unique DNA sequence
tgacacgattcgtagggccg

SEQ ID NO: 3077 - DNA, 20 bp, Artificial
  20-mer unique DNA sequence
aataagagcgcgtcgccaca

SEQ ID NO: 3078 - DNA, 20 bp, Artificial
  20-mer unique DNA sequence
agcggttgtttggaggtggg

SEQ ID NO: 3079 - DNA, 20 bp, Artificial
  20-mer unique DNA sequence
ccaagagccccagaccgaag

SEQ ID NO: 3080 - DNA, 20 bp, Artificial
  20-mer unique DNA sequence
cgcacccctattccactgcc

SEQ ID NO: 3081 - DNA, 20 bp, Artificial
  20-mer unique DNA sequence
agccgacccaaacgagcaga

SEQ ID NO: 3082 - DNA, 20 bp, Artificial
  20-mer unique DNA sequence
ctgccaatagcccctgtcgg

SEQ ID NO: 3083 - DNA, 20 bp, Artificial
  20-mer unique DNA sequence
acgttgaagggggttggacg

SEQ ID NO: 3084 - DNA, 20 bp, Artificial
  20-mer unique DNA sequence
attccggcgtgacccacctg

SEQ ID NO: 3085 - DNA, 20 bp, Artificial
  20-mer unique DNA sequence
gacgagagacgtgggacgcg

SEQ ID NO: 3086 - DNA, 20 bp, Artificial
  20-mer unique DNA sequence
gcaggaggcatttaggccgg

SEQ ID NO: 3087 - DNA, 20 bp, Artificial
  20-mer unique DNA sequence
agatgtggccccgctgtgaa

SEQ ID NO: 3088 - DNA, 20 bp, Artificial
  20-mer unique DNA sequence
ggccttaatcgagcggggga

SEQ ID NO: 3089 - DNA, 20 bp, Artificial
  20-mer unique DNA sequence
tggccagcagacaccgggat

SEQ ID NO: 3090 - DNA, 20 bp, Artificial
  20-mer unique DNA sequence
gcgctaaatccccgctcccc

SEQ ID NO: 3091 - DNA, 20 bp, Artificial
  20-mer unique DNA sequence
gcttcgcgccatgtacctcc

SEQ ID NO: 3092 - DNA, 20 bp, Artificial
  20-mer unique DNA sequence
cctgggttcggggtgccttc

SEQ ID NO: 3093 - DNA, 20 bp, Artificial
  20-mer unique DNA sequence
tggcctttgtcgcgtgggtt

SEQ ID NO: 3094 - DNA, 20 bp, Artificial
  20-mer unique DNA sequence
ccgggaatacccccacaaaa

SEQ ID NO: 3095 - DNA, 20 bp, Artificial
  20-mer unique DNA sequence
ctcgaagccgtctttcccac

SEQ ID NO: 3096 - DNA, 20 bp, Artificial
  20-mer unique DNA sequence
agcctgcaaacatctccccc

SEQ ID NO: 3097 - DNA, 20 bp, Artificial
  20-mer unique DNA sequence
acgcgagctgggacgaacac

SEQ ID NO: 3098 - DNA, 20 bp, Artificial
  20-mer unique DNA sequence
accactcgatcccccgttcc

SEQ ID NO: 3099 - DNA, 20 bp, Artificial
  20-mer unique DNA sequence
tcagatgttgtccgcgtccg

SEQ ID NO: 3100 - DNA, 20 bp, Artificial
  20-mer unique DNA sequence
cacggggtcaaatggcggtc

SEQ ID NO: 3101 - DNA, 20 bp, Artificial
  20-mer unique DNA sequence
ctagggcaggcgttggcatc

SEQ ID NO: 3102 - DNA, 20 bp, Artificial
  20-mer unique DNA sequence
cggagtcgcatgacgaaagc

SEQ ID NO: 3103 - DNA, 20 bp, Artificial
  20-mer unique DNA sequence
agacgcactatcggcggagg

SEQ ID NO: 3104 - DNA, 20 bp, Artificial
  20-mer unique DNA sequence
gcgggcggagaaaaacgtca

SEQ ID NO: 3105 - DNA, 20 bp, Artificial
  20-mer unique DNA sequence
ccaccccgcctcagacgtta

SEQ ID NO: 3106 - DNA, 20 bp, Artificial
  20-mer unique DNA sequence
gcttgcggggatacgacggg

SEQ ID NO: 3107 - DNA, 20 bp, Artificial
  20-mer unique DNA sequence
tagggcagtttggacggcgg

SEQ ID NO: 3108 - DNA, 20 bp, Artificial
  20-mer unique DNA sequence
cgctattggccggggtcttt

SEQ ID NO: 3109 - DNA, 20 bp, Artificial
  20-mer unique DNA sequence
cgtgggcggaggttgaagac

SEQ ID NO: 3110 - DNA, 20 bp, Artificial
  20-mer unique DNA sequence
ctcgcagaaagggccacgtt

SEQ ID NO: 3111 - DNA, 20 bp, Artificial
  20-mer unique DNA sequence
ccccccaaagatagacgcca

SEQ ID NO: 3112 - DNA, 20 bp, Artificial
  20-mer unique DNA sequence
cctataaagccgcgggtcca

SEQ ID NO: 3113 - DNA, 20 bp, Artificial
  20-mer unique DNA sequence
tacacgtcgccttgccccct

SEQ ID NO: 3114 - DNA, 20 bp, Artificial
  20-mer unique DNA sequence
gcatggccgtgggttttgaa

SEQ ID NO: 3115 - DNA, 20 bp, Artificial
  20-mer unique DNA sequence
tggcgggtgcggtctggtac

SEQ ID NO: 3116 - DNA, 20 bp, Artificial
  20-mer unique DNA sequence
cgggggttatcgggacttga

SEQ ID NO: 3117 - DNA, 20 bp, Artificial
  20-mer unique DNA sequence
caaacggtcgcccaacaatg

SEQ ID NO: 3118 - DNA, 20 bp, Artificial
  20-mer unique DNA sequence
ccgcaccaggacaaaccaga

SEQ ID NO: 3119 - DNA, 20 bp, Artificial
  20-mer unique DNA sequence
ccagggggccaaggtacgta

SEQ ID NO: 3120 - DNA, 20 bp, Artificial
  20-mer unique DNA sequence
gagggcgggaagccgaacag

SEQ ID NO: 3121 - DNA, 20 bp, Artificial
  20-mer unique DNA sequence
gttgggtggggttgtctggg

SEQ ID NO: 3122 - DNA, 20 bp, Artificial
  20-mer unique DNA sequence
gccccttccaagtacccgct

SEQ ID NO: 3123 - DNA, 20 bp, Artificial
  20-mer unique DNA sequence
tccacacattaccctcggcg

SEQ ID NO: 3124 - DNA, 20 bp, Artificial
  20-mer unique DNA sequence
ttaggggtggagcggagcat

SEQ ID NO: 3125 - DNA, 20 bp, Artificial
  20-mer unique DNA sequence
gtggctgcggggtcggatac

SEQ ID NO: 3126 - DNA, 20 bp, Artificial
  20-mer unique DNA sequence
tgtagggtatgctggcgggg

SEQ ID NO: 3127 - DNA, 20 bp, Artificial
  20-mer unique DNA sequence
ctgccgacccaaccctctca

SEQ ID NO: 3128 - DNA, 20 bp, Artificial
  20-mer unique DNA sequence
gcagggtttgatagggcggc

SEQ ID NO: 3129 - DNA, 20 bp, Artificial
  20-mer unique DNA sequence
agtgcggaactcgattgtga

SEQ ID NO: 3130 - DNA, 20 bp, Artificial
  20-mer unique DNA sequence
gcgccgtgtgtatagcccaa

SEQ ID NO: 3131 - DNA, 20 bp, Artificial
  20-mer unique DNA sequence
ttgtggggcggctagtgctt

SEQ ID NO: 3132 - DNA, 20 bp, Artificial
  20-mer unique DNA sequence
gcgaggcattgaggcgagtc

SEQ ID NO: 3133 - DNA, 20 bp, Artificial
  20-mer unique DNA sequence
tgattgggggagcctgtgtg

SEQ ID NO: 3134 - DNA, 20 bp, Artificial
  20-mer unique DNA sequence
aggtgggggcaggtaagcgg

SEQ ID NO: 3135 - DNA, 20 bp, Artificial
  20-mer unique DNA sequence
agtgagggggctggcgaagg

SEQ ID NO: 3136 - DNA, 20 bp, Artificial
  20-mer unique DNA sequence
gggttgtggataggcggtgc

SEQ ID NO: 3137 - DNA, 20 bp, Artificial
  20-mer unique DNA sequence
ggaggttgagggcgggggta

SEQ ID NO: 3138 - DNA, 20 bp, Artificial
  20-mer unique DNA sequence
tgggaggtcaagagcggcaa

SEQ ID NO: 3139 - DNA, 20 bp, Artificial
  20-mer unique DNA sequence
cgccggggtgctacctcagt

SEQ ID NO: 3140 - DNA, 20 bp, Artificial
  20-mer unique DNA sequence
gaactcatgagggagggcgg

SEQ ID NO: 3141 - DNA, 20 bp, Artificial
  20-mer unique DNA sequence
gccccgccgatcgagtctct

SEQ ID NO: 3142 - DNA, 20 bp, Artificial
  20-mer unique DNA sequence
aggtggcagggaattgtggc

SEQ ID NO: 3143 - DNA, 20 bp, Artificial
  20-mer unique DNA sequence
tagcccctccggttccttgc

SEQ ID NO: 3144 - DNA, 20 bp, Artificial
  20-mer unique DNA sequence
tgccaccaacgaagcgaatc

SEQ ID NO: 3145 - DNA, 20 bp, Artificial
  20-mer unique DNA sequence
ccgtattccgcgacccctaa

SEQ ID NO: 3146 - DNA, 20 bp, Artificial
  20-mer unique DNA sequence
aggctattgttgggcggggg

SEQ ID NO: 3147 - DNA, 20 bp, Artificial
  20-mer unique DNA sequence
gggaaaatgggttaggggcg

SEQ ID NO: 3148 - DNA, 20 bp, Artificial
  20-mer unique DNA sequence
atacccaactgcccccccac

SEQ ID NO: 3149 - DNA, 20 bp, Artificial
  20-mer unique DNA sequence
gcggcaagttaggagcggaa

SEQ ID NO: 3150 - DNA, 20 bp, Artificial
  20-mer unique DNA sequence
aaagccgcatacccaccacg

SEQ ID NO: 3151 - DNA, 20 bp, Artificial
  20-mer unique DNA sequence
ccagcaacagacgcagccaa

SEQ ID NO: 3152 - DNA, 20 bp, Artificial
  20-mer unique DNA sequence
tggggagccagagaagcggc

SEQ ID NO: 3153 - DNA, 20 bp, Artificial
  20-mer unique DNA sequence
accacgttacctcccgcccc

SEQ ID NO: 3154 - DNA, 20 bp, Artificial
  20-mer unique DNA sequence
tgagccttccgacaattgcg

SEQ ID NO: 3155 - DNA, 20 bp, Artificial
  20-mer unique DNA sequence
ccctgcgccacacatcaagc

SEQ ID NO: 3156 - DNA, 20 bp, Artificial
  20-mer unique DNA sequence
ccagcaagccctcaaaacgc

SEQ ID NO: 3157 - DNA, 20 bp, Artificial
  20-mer unique DNA sequence
tgctcgcttcgttctgcctg

SEQ ID NO: 3158 - DNA, 20 bp, Artificial
  20-mer unique DNA sequence
agatcgccgcaagccaagga

SEQ ID NO: 3159 - DNA, 20 bp, Artificial
  20-mer unique DNA sequence
tgtgttcactccgaggctgc

SEQ ID NO: 3160 - DNA, 20 bp, Artificial
  20-mer unique DNA sequence
gaatgggggcgggctttcaa

SEQ ID NO: 3161 - DNA, 20 bp, Artificial
  20-mer unique DNA sequence
gtcgtggggggagataggcg

SEQ ID NO: 3162 - DNA, 20 bp, Artificial
  20-mer unique DNA sequence
acatgcccatcgcggaccga

SEQ ID NO: 3163 - DNA, 20 bp, Artificial
  20-mer unique DNA sequence
ggggcgttactccgagcagg

SEQ ID NO: 3164 - DNA, 20 bp, Artificial
  20-mer unique DNA sequence
ttggacggggatttacggcg

SEQ ID NO: 3165 - DNA, 20 bp, Artificial
  20-mer unique DNA sequence
ggtcagaatgggtcgcggac

SEQ ID NO: 3166 - DNA, 20 bp, Artificial
  20-mer unique DNA sequence
cggacggagaggcgggtaca

SEQ ID NO: 3167 - DNA, 20 bp, Artificial
  20-mer unique DNA sequence
ttccaaggcgcgggtatcaa

SEQ ID NO: 3168 - DNA, 20 bp, Artificial
  20-mer unique DNA sequence
ctgaccctcgcccggaatgt

SEQ ID NO: 3169 - DNA, 20 bp, Artificial
  20-mer unique DNA sequence
tccattagtgctgcgtcggg

SEQ ID NO: 3170 - DNA, 20 bp, Artificial
  20-mer unique DNA sequence
cgttgatcaggcagggcaag

SEQ ID NO: 3171 - DNA, 20 bp, Artificial
  20-mer unique DNA sequence
cgcgcttcacgtacgtcgtt

SEQ ID NO: 3172 - DNA, 20 bp, Artificial
  20-mer unique DNA sequence
cgcgcgaccccaataaaccc

SEQ ID NO: 3173 - DNA, 20 bp, Artificial
  20-mer unique DNA sequence
cgtttggaaggggtgcgtca

SEQ ID NO: 3174 - DNA, 20 bp, Artificial
  20-mer unique DNA sequence
cgagttggggagcccgtgtc

SEQ ID NO: 3175 - DNA, 20 bp, Artificial
  20-mer unique DNA sequence
caggttcatggcgccgtctc

SEQ ID NO: 3176 - DNA, 20 bp, Artificial
  20-mer unique DNA sequence
ttatgcgacgggcggacgat

SEQ ID NO: 3177 - DNA, 20 bp, Artificial
  20-mer unique DNA sequence
gcattgatcgggcagacggc

SEQ ID NO: 3178 - DNA, 20 bp, Artificial
  20-mer unique DNA sequence
tagggggcggaggacggtat

SEQ ID NO: 3179 - DNA, 20 bp, Artificial
  20-mer unique DNA sequence
aatccccgtcccattccagc

SEQ ID NO: 3180 - DNA, 20 bp, Artificial
  20-mer unique DNA sequence
gcacaacggggaaatggagg

SEQ ID NO: 3181 - DNA, 20 bp, Artificial
  20-mer unique DNA sequence
tcgattcctgtcctcccggg

SEQ ID NO: 3182 - DNA, 20 bp, Artificial
  20-mer unique DNA sequence
ccccctccgtcttcgcctta

SEQ ID NO: 3183 - DNA, 20 bp, Artificial
  20-mer unique DNA sequence
tgacgggcattgttggggac

SEQ ID NO: 3184 - DNA, 20 bp, Artificial
  20-mer unique DNA sequence
gcggcggtagagccgttatt

SEQ ID NO: 3185 - DNA, 20 bp, Artificial
  20-mer unique DNA sequence
cgcggtgggagaagtgggta

SEQ ID NO: 3186 - DNA, 20 bp, Artificial
  20-mer unique DNA sequence
gggaacgccagtagccggat

SEQ ID NO: 3187 - DNA, 20 bp, Artificial
  20-mer unique DNA sequence
gtcggttatgggtgggtcgc

SEQ ID NO: 3188 - DNA, 20 bp, Artificial
  20-mer unique DNA sequence
gggtgtgactggcggggaaa

SEQ ID NO: 3189 - DNA, 20 bp, Artificial
  20-mer unique DNA sequence
tggagcgtatggagggcagg

SEQ ID NO: 3190 - DNA, 20 bp, Artificial
  20-mer unique DNA sequence
tcacccagcccgcagttaca

SEQ ID NO: 3191 - DNA, 20 bp, Artificial
  20-mer unique DNA sequence
ccggaatgaacgtaggcgcc

SEQ ID NO: 3192 - DNA, 20 bp, Artificial
  20-mer unique DNA sequence
agcccaacagccgaccagtc

SEQ ID NO: 3193 - DNA, 20 bp, Artificial
  20-mer unique DNA sequence
gagttgggaagcacgacgcc

SEQ ID NO: 3194 - DNA, 20 bp, Artificial
  20-mer unique DNA sequence
ggcctgctgaacgaaccgat

SEQ ID NO: 3195 - DNA, 20 bp, Artificial
  20-mer unique DNA sequence
tcgggccaacatgatccagc

SEQ ID NO: 3196 - DNA, 20 bp, Artificial
  20-mer unique DNA sequence
accgggtgtggagctgcatg

SEQ ID NO: 3197 - DNA, 20 bp, Artificial
  20-mer unique DNA sequence
agaccgtagcgggaaggggt

SEQ ID NO: 3198 - DNA, 20 bp, Artificial
  20-mer unique DNA sequence
gaggagactgtggtgggggc

SEQ ID NO: 3199 - DNA, 20 bp, Artificial
  20-mer unique DNA sequence
acgttacgtactacgcggct

SEQ ID NO: 3200 - DNA, 20 bp, Artificial
  20-mer unique DNA sequence
cctcgcgtccgatttgtgag

SEQ ID NO: 3201 - DNA, 20 bp, Artificial
  20-mer unique DNA sequence
cgcgtcagctacccccgata

SEQ ID NO: 3202 - DNA, 20 bp, Artificial
  20-mer unique DNA sequence
ttccgcgcagtttgggtctg

SEQ ID NO: 3203 - DNA, 20 bp, Artificial
  20-mer unique DNA sequence
acaagcgttcccggactgag

SEQ ID NO: 3204 - DNA, 20 bp, Artificial
  20-mer unique DNA sequence
gtcctcttggcccccgtctc

SEQ ID NO: 3205 - DNA, 20 bp, Artificial
  20-mer unique DNA sequence
attcggcttgttggctcccc

SEQ ID NO: 3206 - DNA, 20 bp, Artificial
  20-mer unique DNA sequence
ccgggggctgagacacaatg

SEQ ID NO: 3207 - DNA, 20 bp, Artificial
  20-mer unique DNA sequence
cttgtgggggcgaaccgcta

SEQ ID NO: 3208 - DNA, 20 bp, Artificial
  20-mer unique DNA sequence
taactgcgcaaccgggaagg

SEQ ID NO: 3209 - DNA, 20 bp, Artificial
  20-mer unique DNA sequence
gctgttctcgtcgtcgcctg

SEQ ID NO: 3210 - DNA, 20 bp, Artificial
  20-mer unique DNA sequence
tgactgcaagcggcccgata

SEQ ID NO: 3211 - DNA, 20 bp, Artificial
  20-mer unique DNA sequence
agctttgcggctacgggcag

SEQ ID NO: 3212 - DNA, 20 bp, Artificial
  20-mer unique DNA sequence
attggattgcggcccttgag

SEQ ID NO: 3213 - DNA, 20 bp, Artificial
  20-mer unique DNA sequence
gcgctcggatatgggtatcg

SEQ ID NO: 3214 - DNA, 20 bp, Artificial
  20-mer unique DNA sequence
agcggtgcgaagggtgaagg

SEQ ID NO: 3215 - DNA, 20 bp, Artificial
  20-mer unique DNA sequence
aactgggcgtaggacagggc

SEQ ID NO: 3216 - DNA, 20 bp, Artificial
  20-mer unique DNA sequence
caccccgccctgtaatcgct

SEQ ID NO: 3217 - DNA, 20 bp, Artificial
  20-mer unique DNA sequence
cagaaaccgcccagcaagcg

SEQ ID NO: 3218 - DNA, 20 bp, Artificial
  20-mer unique DNA sequence
ggctcccgcaaaccccattg

SEQ ID NO: 3219 - DNA, 20 bp, Artificial
  20-mer unique DNA sequence
cccagccctgcatcacacac

SEQ ID NO: 3220 - DNA, 20 bp, Artificial
  20-mer unique DNA sequence
tgcccgtgtaactctccccg

SEQ ID NO: 3221 - DNA, 20 bp, Artificial
  20-mer unique DNA sequence
tccctattccccgtgccctg

SEQ ID NO: 3222 - DNA, 20 bp, Artificial
  20-mer unique DNA sequence
gcagaaccctcccgccagta

SEQ ID NO: 3223 - DNA, 20 bp, Artificial
  20-mer unique DNA sequence
ccgtccgtccatcttctgcc

SEQ ID NO: 3224 - DNA, 20 bp, Artificial
  20-mer unique DNA sequence
acatttaaccccggacccgc

SEQ ID NO: 3225 - DNA, 20 bp, Artificial
  20-mer unique DNA sequence
aagtcgcccgagagttaggc

SEQ ID NO: 3226 - DNA, 20 bp, Artificial
  20-mer unique DNA sequence
acgggattcggtctgtcgtt

SEQ ID NO: 3227 - DNA, 20 bp, Artificial
  20-mer unique DNA sequence
cgtttggttgggttgcgtcg

SEQ ID NO: 3228 - DNA, 20 bp, Artificial
  20-mer unique DNA sequence
acagcgtcctcccagcccag

SEQ ID NO: 3229 - DNA, 20 bp, Artificial
  20-mer unique DNA sequence
aggaaagcaaaaccccccga

SEQ ID NO: 3230 - DNA, 20 bp, Artificial
  20-mer unique DNA sequence
tgcttttaggtcgtggcggg

SEQ ID NO: 3231 - DNA, 20 bp, Artificial
  20-mer unique DNA sequence
gcggttggcgggtgtgtagg

SEQ ID NO: 3232 - DNA, 20 bp, Artificial
  20-mer unique DNA sequence
acggcaggcggctctaacac

SEQ ID NO: 3233 - DNA, 20 bp, Artificial
  20-mer unique DNA sequence
cgcactttgcatgaacgccg

SEQ ID NO: 3234 - DNA, 20 bp, Artificial
  20-mer unique DNA sequence
ggacgtttgatcggggcaga

SEQ ID NO: 3235 - DNA, 20 bp, Artificial
  20-mer unique DNA sequence
gcggagcgatatggggaaca

SEQ ID NO: 3236 - DNA, 20 bp, Artificial
  20-mer unique DNA sequence
gtgagggaccgtatggcaga

SEQ ID NO: 3237 - DNA, 20 bp, Artificial
  20-mer unique DNA sequence
cgggggggtctgccttgtat

SEQ ID NO: 3238 - DNA, 20 bp, Artificial
  20-mer unique DNA sequence
cgcccctcctcctctgccta

SEQ ID NO: 3239 - DNA, 20 bp, Artificial
  20-mer unique DNA sequence
cattaacgtctggccgcgcc

SEQ ID NO: 3240 - DNA, 20 bp, Artificial
  20-mer unique DNA sequence
cctgtagcgcccggtgttcg

SEQ ID NO: 3241 - DNA, 20 bp, Artificial
  20-mer unique DNA sequence
tccctggcagctctgacgta

SEQ ID NO: 3242 - DNA, 20 bp, Artificial
  20-mer unique DNA sequence
tgaccgccacctcgacgttg

SEQ ID NO: 3243 - DNA, 20 bp, Artificial
  20-mer unique DNA sequence
cgtatgagcccgacgtcccc

SEQ ID NO: 3244 - DNA, 20 bp, Artificial
  20-mer unique DNA sequence
ccgtccatccgccttatcca

SEQ ID NO: 3245 - DNA, 20 bp, Artificial
  20-mer unique DNA sequence
attcgtcgggtgtcgtcggg

SEQ ID NO: 3246 - DNA, 20 bp, Artificial
  20-mer unique DNA sequence
tcgcgtcgttccgtttggta

SEQ ID NO: 3247 - DNA, 20 bp, Artificial
  20-mer unique DNA sequence
ctgcccgtattttcctcccg

SEQ ID NO: 3248 - DNA, 20 bp, Artificial
  20-mer unique DNA sequence
atcctgttagccccctgccc

SEQ ID NO: 3249 - DNA, 20 bp, Artificial
  20-mer unique DNA sequence
aatcttcgtcttgcgcggct

SEQ ID NO: 3250 - DNA, 20 bp, Artificial
  20-mer unique DNA sequence
tgcccacctgtttcaccacg

SEQ ID NO: 3251 - DNA, 20 bp, Artificial
  20-mer unique DNA sequence
agcggttcgggtggagtgat

SEQ ID NO: 3252 - DNA, 20 bp, Artificial
  20-mer unique DNA sequence
tcaactctgcgggctcctcg

SEQ ID NO: 3253 - DNA, 20 bp, Artificial
  20-mer unique DNA sequence
tgcatgaccgcccagtttgg

SEQ ID NO: 3254 - DNA, 20 bp, Artificial
  20-mer unique DNA sequence
aaccacccgagcaccagcct

SEQ ID NO: 3255 - DNA, 20 bp, Artificial
  20-mer unique DNA sequence
ttacgggtgggcgtgtatgc

SEQ ID NO: 3256 - DNA, 20 bp, Artificial
  20-mer unique DNA sequence
tgattggagcgcgtctggga

SEQ ID NO: 3257 - DNA, 20 bp, Artificial
  20-mer unique DNA sequence
cggctttcgcttctggggtt

SEQ ID NO: 3258 - DNA, 20 bp, Artificial
  20-mer unique DNA sequence
gacccacccgcatcacaacc

SEQ ID NO: 3259 - DNA, 20 bp, Artificial
  20-mer unique DNA sequence
acagtcctgccgtctgcgaa

SEQ ID NO: 3260 - DNA, 20 bp, Artificial
  20-mer unique DNA sequence
ggggcaagaccaggatgggg

SEQ ID NO: 3261 - DNA, 20 bp, Artificial
  20-mer unique DNA sequence
ctctgggcttgggcctggta

SEQ ID NO: 3262 - DNA, 20 bp, Artificial
  20-mer unique DNA sequence
accgtcatcaccaacaccgc

SEQ ID NO: 3263 - DNA, 20 bp, Artificial
  20-mer unique DNA sequence
tcgagggcgcgcttaacact

SEQ ID NO: 3264 - DNA, 20 bp, Artificial
  20-mer unique DNA sequence
attatggcggaggcgggggt

SEQ ID NO: 3265 - DNA, 20 bp, Artificial
  20-mer unique DNA sequence
cgaacgaagcattccagggc

SEQ ID NO: 3266 - DNA, 20 bp, Artificial
  20-mer unique DNA sequence
ccgttaccgctttgccctgg

SEQ ID NO: 3267 - DNA, 20 bp, Artificial
  20-mer unique DNA sequence
gggggagtcgcggtgcttgt

SEQ ID NO: 3268 - DNA, 20 bp, Artificial
  20-mer unique DNA sequence
ccctgcccttcacctcatcg

SEQ ID NO: 3269 - DNA, 20 bp, Artificial
  20-mer unique DNA sequence
ggcaggggcttacggtcggt

SEQ ID NO: 3270 - DNA, 20 bp, Artificial
  20-mer unique DNA sequence
tcgccccgtaccctaccacg

SEQ ID NO: 3271 - DNA, 20 bp, Artificial
  20-mer unique DNA sequence
gattaaagcgacgcgaggcc

SEQ ID NO: 3272 - DNA, 20 bp, Artificial
  20-mer unique DNA sequence
tagggggcgggcttgtgtcc

SEQ ID NO: 3273 - DNA, 20 bp, Artificial
  20-mer unique DNA sequence
cagaaggatccgggcgcaac

SEQ ID NO: 3274 - DNA, 20 bp, Artificial
  20-mer unique DNA sequence
aagacatgtggccaaccccc

SEQ ID NO: 3275 - DNA, 20 bp, Artificial
  20-mer unique DNA sequence
ccccaacagcggcatagatg

SEQ ID NO: 3276 - DNA, 20 bp, Artificial
  20-mer unique DNA sequence
atttcccgagcaccccttcc

SEQ ID NO: 3277 - DNA, 20 bp, Artificial
  20-mer unique DNA sequence
tcctcctagcccgcaactcg

SEQ ID NO: 3278 - DNA, 20 bp, Artificial
  20-mer unique DNA sequence
tttgtggcgggaactatgcg

SEQ ID NO: 3279 - DNA, 20 bp, Artificial
  20-mer unique DNA sequence
tctcggtgcgggggtgtttc

SEQ ID NO: 3280 - DNA, 20 bp, Artificial
  20-mer unique DNA sequence
cagggggtgtcatgctgggg

SEQ ID NO: 3281 - DNA, 20 bp, Artificial
  20-mer unique DNA sequence
tgcttgtgggaccctgcgct

SEQ ID NO: 3282 - DNA, 20 bp, Artificial
  20-mer unique DNA sequence
gcggcgaatgaagtgaggct

SEQ ID NO: 3283 - DNA, 20 bp, Artificial
  20-mer unique DNA sequence
ggggactggtgatggcgatg

SEQ ID NO: 3284 - DNA, 20 bp, Artificial
  20-mer unique DNA sequence
cggcgtcggtgaggaaggat

SEQ ID NO: 3285 - DNA, 20 bp, Artificial
  20-mer unique DNA sequence
agtcgtctagaccgtcgggt

SEQ ID NO: 3286 - DNA, 20 bp, Artificial
  20-mer unique DNA sequence
cgttgatccgccgcttatgc

SEQ ID NO: 3287 - DNA, 20 bp, Artificial
  20-mer unique DNA sequence
cgctgctcctgccttcgatg

SEQ ID NO: 3288 - DNA, 20 bp, Artificial
  20-mer unique DNA sequence
cttttggcaggggaccggag

SEQ ID NO: 3289 - DNA, 20 bp, Artificial
  20-mer unique DNA sequence
atgctttggagggaacggga

SEQ ID NO: 3290 - DNA, 20 bp, Artificial
  20-mer unique DNA sequence
ccaatcggcgtcaatgcttg

SEQ ID NO: 3291 - DNA, 20 bp, Artificial
  20-mer unique DNA sequence
aggggctgggacgggggaca

SEQ ID NO: 3292 - DNA, 20 bp, Artificial
  20-mer unique DNA sequence
cgagaaccaagcgggtggga

SEQ ID NO: 3293 - DNA, 20 bp, Artificial
  20-mer unique DNA sequence
ggcggctgatatgtcgggac

SEQ ID NO: 3294 - DNA, 20 bp, Artificial
  20-mer unique DNA sequence
cccgatgtagcgccgagttc

SEQ ID NO: 3295 - DNA, 20 bp, Artificial
  20-mer unique DNA sequence
agggctgcggggaatatcgt

SEQ ID NO: 3296 - DNA, 20 bp, Artificial
  20-mer unique DNA sequence
tgtagacaacggccgagccc

SEQ ID NO: 3297 - DNA, 20 bp, Artificial
  20-mer unique DNA sequence
tttgggcggaaagccacttg

SEQ ID NO: 3298 - DNA, 20 bp, Artificial
  20-mer unique DNA sequence
cgtgccccactcgtctcctg

SEQ ID NO: 3299 - DNA, 20 bp, Artificial
  20-mer unique DNA sequence
tgttccgttttcggttggca

SEQ ID NO: 3300 - DNA, 20 bp, Artificial
  20-mer unique DNA sequence
aggcctccagcgaattagcg

SEQ ID NO: 3301 - DNA, 20 bp, Artificial
  20-mer unique DNA sequence
ctccccagctgtcgtccccg

SEQ ID NO: 3302 - DNA, 20 bp, Artificial
  20-mer unique DNA sequence
ttccccctattcgcacacgg

SEQ ID NO: 3303 - DNA, 20 bp, Artificial
  20-mer unique DNA sequence
ttcggagttggatgggcggt

SEQ ID NO: 3304 - DNA, 20 bp, Artificial
  20-mer unique DNA sequence
atcggcaaggtcggtcaggc

SEQ ID NO: 3305 - DNA, 20 bp, Artificial
  20-mer unique DNA sequence
acagggagggccgggtaact

SEQ ID NO: 3306 - DNA, 20 bp, Artificial
  20-mer unique DNA sequence
gcccctaagcctccatcccg

SEQ ID NO: 3307 - DNA, 20 bp, Artificial
  20-mer unique DNA sequence
taacccaggctctcgtgcca

SEQ ID NO: 3308 - DNA, 20 bp, Artificial
  20-mer unique DNA sequence
gggcgtggtcgggatggtat

SEQ ID NO: 3309 - DNA, 20 bp, Artificial
  20-mer unique DNA sequence
ttagttttgggttgcggggc

SEQ ID NO: 3310 - DNA, 20 bp, Artificial
  20-mer unique DNA sequence
caactagcggggtggctcga

SEQ ID NO: 3311 - DNA, 20 bp, Artificial
  20-mer unique DNA sequence
actcgcgggtactcacgctt

SEQ ID NO: 3312 - DNA, 20 bp, Artificial
  20-mer unique DNA sequence
tgcaaatgagccccacgtcg

SEQ ID NO: 3313 - DNA, 20 bp, Artificial
  20-mer unique DNA sequence
tgcgttgatggggaggttga

SEQ ID NO: 3314 - DNA, 20 bp, Artificial
  20-mer unique DNA sequence
tcaccgtcagtccccgccac

SEQ ID NO: 3315 - DNA, 20 bp, Artificial
  20-mer unique DNA sequence
ggggtgtggcggacgaaatt

SEQ ID NO: 3316 - DNA, 20 bp, Artificial
  20-mer unique DNA sequence
acgggtctggtctttggggg

SEQ ID NO: 3317 - DNA, 20 bp, Artificial
  20-mer unique DNA sequence
cgctaacatgggctcgggat

SEQ ID NO: 3318 - DNA, 20 bp, Artificial
  20-mer unique DNA sequence
aagccaaggagggggtgcca

SEQ ID NO: 3319 - DNA, 20 bp, Artificial
  20-mer unique DNA sequence
gcccatcgatgaccctccag

SEQ ID NO: 3320 - DNA, 20 bp, Artificial
  20-mer unique DNA sequence
cgaggggacatgtgggggta

SEQ ID NO: 3321 - DNA, 20 bp, Artificial
  20-mer unique DNA sequence
ggacgagtagggggagcgcg

SEQ ID NO: 3322 - DNA, 20 bp, Artificial
  20-mer unique DNA sequence
gtcatcttccgtgggccctc

SEQ ID NO: 3323 - DNA, 20 bp, Artificial
  20-mer unique DNA sequence
acccacccgcccccgttaat

SEQ ID NO: 3324 - DNA, 20 bp, Artificial
  20-mer unique DNA sequence
ggaaccgcagaacacgtgac

SEQ ID NO: 3325 - DNA, 20 bp, Artificial
  20-mer unique DNA sequence
tggagggctaggaggcgtgg

SEQ ID NO: 3326 - DNA, 20 bp, Artificial
  20-mer unique DNA sequence
ccgttgcaaccgatttggga

SEQ ID NO: 3327 - DNA, 20 bp, Artificial
  20-mer unique DNA sequence
ggctgaagtcgatggcggaa

SEQ ID NO: 3328 - DNA, 20 bp, Artificial
  20-mer unique DNA sequence
agcacgctattacccgccga

SEQ ID NO: 3329 - DNA, 20 bp, Artificial
  20-mer unique DNA sequence
tatcctagcacgcgggggtt

SEQ ID NO: 3330 - DNA, 20 bp, Artificial
  20-mer unique DNA sequence
gcaagccggccaatcagtcc

SEQ ID NO: 3331 - DNA, 20 bp, Artificial
  20-mer unique DNA sequence
tcgtcgccgtgcctcatttc

SEQ ID NO: 3332 - DNA, 20 bp, Artificial
  20-mer unique DNA sequence
cccgcgaggtgttcctaacc

SEQ ID NO: 3333 - DNA, 20 bp, Artificial
  20-mer unique DNA sequence
cattcactaccgcccccagg

SEQ ID NO: 3334 - DNA, 20 bp, Artificial
  20-mer unique DNA sequence
gagcggcgaacgttgcaaac

SEQ ID NO: 3335 - DNA, 20 bp, Artificial
  20-mer unique DNA sequence
ggacggtgggatcttgcgat

SEQ ID NO: 3336 - DNA, 20 bp, Artificial
  20-mer unique DNA sequence
tgcaataccggccgaaagga

SEQ ID NO: 3337 - DNA, 20 bp, Artificial
  20-mer unique DNA sequence
cccggggttgcgaaagttga

SEQ ID NO: 3338 - DNA, 20 bp, Artificial
  20-mer unique DNA sequence
cccgaactgacaaagggccg

SEQ ID NO: 3339 - DNA, 20 bp, Artificial
  20-mer unique DNA sequence
gtactaggcgcccggttggc

SEQ ID NO: 3340 - DNA, 20 bp, Artificial
  20-mer unique DNA sequence
aacgcggaaatttggggctc

SEQ ID NO: 3341 - DNA, 20 bp, Artificial
  20-mer unique DNA sequence
tgtgtggggtatccgaggcg

SEQ ID NO: 3342 - DNA, 20 bp, Artificial
  20-mer unique DNA sequence
tcacgccggtaagcgacagt

SEQ ID NO: 3343 - DNA, 20 bp, Artificial
  20-mer unique DNA sequence
acgcctatacccccatcgcc

SEQ ID NO: 3344 - DNA, 20 bp, Artificial
  20-mer unique DNA sequence
tgcgtccccttcagctcgtc

SEQ ID NO: 3345 - DNA, 20 bp, Artificial
  20-mer unique DNA sequence
gtccaacagggccgaagcat

SEQ ID NO: 3346 - DNA, 20 bp, Artificial
  20-mer unique DNA sequence
ttacgtagtgcatgccgggg

SEQ ID NO: 3347 - DNA, 20 bp, Artificial
  20-mer unique DNA sequence
tccacattcgcaaagccacg

SEQ ID NO: 3348 - DNA, 20 bp, Artificial
  20-mer unique DNA sequence
aagagcgcagagcgagccag

SEQ ID NO: 3349 - DNA, 20 bp, Artificial
  20-mer unique DNA sequence
tgccgcgttaaattcccatg

SEQ ID NO: 3350 - DNA, 20 bp, Artificial
  20-mer unique DNA sequence
caggcacgaaaccgcaagga

SEQ ID NO: 3351 - DNA, 20 bp, Artificial
  20-mer unique DNA sequence
aggaaaaggccggatcgtca

SEQ ID NO: 3352 - DNA, 20 bp, Artificial
  20-mer unique DNA sequence
aggacgcaccaaccgacgat

SEQ ID NO: 3353 - DNA, 20 bp, Artificial
  20-mer unique DNA sequence
tacaacccatcgcaagcgca

SEQ ID NO: 3354 - DNA, 20 bp, Artificial
  20-mer unique DNA sequence
gcgatgtttgagatgggcgg

SEQ ID NO: 3355 - DNA, 20 bp, Artificial
  20-mer unique DNA sequence
gagagagcgactgggggtgg

SEQ ID NO: 3356 - DNA, 20 bp, Artificial
  20-mer unique DNA sequence
cggcttccagcaaactccca

SEQ ID NO: 3357 - DNA, 20 bp, Artificial
  20-mer unique DNA sequence
aaacctagggggaatgcggg

SEQ ID NO: 3358 - DNA, 20 bp, Artificial
  20-mer unique DNA sequence
ttgcgccttgacgtacccgg

SEQ ID NO: 3359 - DNA, 20 bp, Artificial
  20-mer unique DNA sequence
tccttggtacggggtggctc

SEQ ID NO: 3360 - DNA, 20 bp, Artificial
  20-mer unique DNA sequence
tgggaacggcgggattgtag

SEQ ID NO: 3361 - DNA, 20 bp, Artificial
  20-mer unique DNA sequence
acactacccgcacgcaaccc

SEQ ID NO: 3362 - DNA, 20 bp, Artificial
  20-mer unique DNA sequence
gcgtgatcaaggaggcggtg

SEQ ID NO: 3363 - DNA, 20 bp, Artificial
  20-mer unique DNA sequence
gccgtgaaggattgggaggt

SEQ ID NO: 3364 - DNA, 20 bp, Artificial
  20-mer unique DNA sequence
gtggtgggggagatgagggg

SEQ ID NO: 3365 - DNA, 20 bp, Artificial
  20-mer unique DNA sequence
ccgtcaacaatcacgcagca

SEQ ID NO: 3366 - DNA, 20 bp, Artificial
  20-mer unique DNA sequence
tcgttcgccccccatcctag

SEQ ID NO: 3367 - DNA, 20 bp, Artificial
  20-mer unique DNA sequence
acgcctgccattccccattt

SEQ ID NO: 3368 - DNA, 20 bp, Artificial
  20-mer unique DNA sequence
cccgcaagcaaccagacacg

SEQ ID NO: 3369 - DNA, 20 bp, Artificial
  20-mer unique DNA sequence
acacacccactccgcagcaa

SEQ ID NO: 3370 - DNA, 20 bp, Artificial
  20-mer unique DNA sequence
catcccccgatcagtttggc

SEQ ID NO: 3371 - DNA, 20 bp, Artificial
  20-mer unique DNA sequence
attccgaccccgagccgtta

SEQ ID NO: 3372 - DNA, 20 bp, Artificial
  20-mer unique DNA sequence
caaacccgcggagacaggaa

SEQ ID NO: 3373 - DNA, 20 bp, Artificial
  20-mer unique DNA sequence
tgggcgggtacatgggagat

SEQ ID NO: 3374 - DNA, 20 bp, Artificial
  20-mer unique DNA sequence
tggagcgagcggagacggag

SEQ ID NO: 3375 - DNA, 20 bp, Artificial
  20-mer unique DNA sequence
ccgcccaccgtaaagcaatc

SEQ ID NO: 3376 - DNA, 20 bp, Artificial
  20-mer unique DNA sequence
gcaagccagccacatcacca

SEQ ID NO: 3377 - DNA, 20 bp, Artificial
  20-mer unique DNA sequence
tcggtggtacacgtatggcg

SEQ ID NO: 3378 - DNA, 20 bp, Artificial
  20-mer unique DNA sequence
caggcgagggacgttggggt

SEQ ID NO: 3379 - DNA, 20 bp, Artificial
  20-mer unique DNA sequence
tcggtgcgcaggcttttgag

SEQ ID NO: 3380 - DNA, 20 bp, Artificial
  20-mer unique DNA sequence
aagtagggctcggtcgggga

SEQ ID NO: 3381 - DNA, 20 bp, Artificial
  20-mer unique DNA sequence
cgcgtggatggggtcaaaag

SEQ ID NO: 3382 - DNA, 20 bp, Artificial
  20-mer unique DNA sequence
agggatcgggtgctagggct

SEQ ID NO: 3383 - DNA, 20 bp, Artificial
  20-mer unique DNA sequence
gggccgtggtcgtgagtgtg

SEQ ID NO: 3384 - DNA, 20 bp, Artificial
  20-mer unique DNA sequence
caccgggtccgttcgaatct

SEQ ID NO: 3385 - DNA, 20 bp, Artificial
  20-mer unique DNA sequence
taggagcccggtcactgcta

SEQ ID NO: 3386 - DNA, 20 bp, Artificial
  20-mer unique DNA sequence
caggcaaggcgggacgatta

SEQ ID NO: 3387 - DNA, 20 bp, Artificial
  20-mer unique DNA sequence
gtgtccccgacgataagacg

SEQ ID NO: 3388 - DNA, 20 bp, Artificial
  20-mer unique DNA sequence
tgaaataccggcagccacgc

SEQ ID NO: 3389 - DNA, 20 bp, Artificial
  20-mer unique DNA sequence
tgtgcggtcgctgtggctgg

SEQ ID NO: 3390 - DNA, 20 bp, Artificial
  20-mer unique DNA sequence
tttgcttctttgggcgggca

SEQ ID NO: 3391 - DNA, 20 bp, Artificial
  20-mer unique DNA sequence
gggcttcgggtgctggttta

SEQ ID NO: 3392 - DNA, 20 bp, Artificial
  20-mer unique DNA sequence
acccgccgatgccagatatg

SEQ ID NO: 3393 - DNA, 20 bp, Artificial
  20-mer unique DNA sequence
gcaatgggcacgggaacaaa

SEQ ID NO: 3394 - DNA, 20 bp, Artificial
  20-mer unique DNA sequence
tccaatgcagtcccccgttt

SEQ ID NO: 3395 - DNA, 20 bp, Artificial
  20-mer unique DNA sequence
gatggaatgcgggggaatga

SEQ ID NO: 3396 - DNA, 20 bp, Artificial
  20-mer unique DNA sequence
acgcccaaggtcaaaggcca

SEQ ID NO: 3397 - DNA, 20 bp, Artificial
  20-mer unique DNA sequence
cgtgcaagccaggtccaaaa

SEQ ID NO: 3398 - DNA, 20 bp, Artificial
  20-mer unique DNA sequence
acgtgagcgtacgtgcgaat

SEQ ID NO: 3399 - DNA, 20 bp, Artificial
  20-mer unique DNA sequence
cctagcgcatatagcccgca

SEQ ID NO: 3400 - DNA, 20 bp, Artificial
  20-mer unique DNA sequence
ttgacggccggcaggtattt

SEQ ID NO: 3401 - DNA, 20 bp, Artificial
  20-mer unique DNA sequence
taccaccagcgcgcacacct

SEQ ID NO: 3402 - DNA, 20 bp, Artificial
  20-mer unique DNA sequence
tgagcgcgaagtgtgggagt

SEQ ID NO: 3403 - DNA, 20 bp, Artificial
  20-mer unique DNA sequence
tcccccctaccgaccccctc

SEQ ID NO: 3404 - DNA, 20 bp, Artificial
  20-mer unique DNA sequence
agcgccgtgtgatttggaca

SEQ ID NO: 3405 - DNA, 20 bp, Artificial
  20-mer unique DNA sequence
cccactgcattaggcgcacc

SEQ ID NO: 3406 - DNA, 20 bp, Artificial
  20-mer unique DNA sequence
gcgcgtggagataaaaggcg

SEQ ID NO: 3407 - DNA, 20 bp, Artificial
  20-mer unique DNA sequence
cagggatcggcataacggcg

SEQ ID NO: 3408 - DNA, 20 bp, Artificial
  20-mer unique DNA sequence
cgggggggctgtcctaattt

SEQ ID NO: 3409 - DNA, 20 bp, Artificial
  20-mer unique DNA sequence
aaattaatgggggtcgtgcg

SEQ ID NO: 3410 - DNA, 20 bp, Artificial
  20-mer unique DNA sequence
cctcctggccgctgaatcca

SEQ ID NO: 3411 - DNA, 20 bp, Artificial
  20-mer unique DNA sequence
tcccgcccggtaatcagtgg

SEQ ID NO: 3412 - DNA, 20 bp, Artificial
  20-mer unique DNA sequence
acaacaaaatgcaccacccg

SEQ ID NO: 3413 - DNA, 20 bp, Artificial
  20-mer unique DNA sequence
cgaacgcggcaccagaatag

SEQ ID NO: 3414 - DNA, 20 bp, Artificial
  20-mer unique DNA sequence
cgcatcccgtttccccagag

SEQ ID NO: 3415 - DNA, 20 bp, Artificial
  20-mer unique DNA sequence
aagccgccctacaaaccccg

SEQ ID NO: 3416 - DNA, 20 bp, Artificial
  20-mer unique DNA sequence
ctgcccgaccgcccctctta

SEQ ID NO: 3417 - DNA, 20 bp, Artificial
  20-mer unique DNA sequence
cgagaaacctgccaacccgc

SEQ ID NO: 3418 - DNA, 20 bp, Artificial
  20-mer unique DNA sequence
tacggctggcgggtttgagg

SEQ ID NO: 3419 - DNA, 20 bp, Artificial
  20-mer unique DNA sequence
ggtttggatggggcggtctg

SEQ ID NO: 3420 - DNA, 20 bp, Artificial
  20-mer unique DNA sequence
gcgcatggttgggttgggac

SEQ ID NO: 3421 - DNA, 20 bp, Artificial
  20-mer unique DNA sequence
cggacccttcttacccccga

SEQ ID NO: 3422 - DNA, 20 bp, Artificial
  20-mer unique DNA sequence
taggttggcgcaaagggctc

SEQ ID NO: 3423 - DNA, 20 bp, Artificial
  20-mer unique DNA sequence
atgcgttctccaatgcggtg

SEQ ID NO: 3424 - DNA, 20 bp, Artificial
  20-mer unique DNA sequence
gctgacgcggattggactgg

SEQ ID NO: 3425 - DNA, 20 bp, Artificial
  20-mer unique DNA sequence
gaggttgtcgcgcgggtcag

SEQ ID NO: 3426 - DNA, 20 bp, Artificial
  20-mer unique DNA sequence
tctgtgctaccgggggggaa

SEQ ID NO: 3427 - DNA, 20 bp, Artificial
  20-mer unique DNA sequence
accctaacaaacggcccggg

SEQ ID NO: 3428 - DNA, 20 bp, Artificial
  20-mer unique DNA sequence
tgccacaacccatctcgcgt

SEQ ID NO: 3429 - DNA, 20 bp, Artificial
  20-mer unique DNA sequence
cttcacccggccgcatcaaa

SEQ ID NO: 3430 - DNA, 20 bp, Artificial
  20-mer unique DNA sequence
ttctcgctcctacgcaccag

SEQ ID NO: 3431 - DNA, 20 bp, Artificial
  20-mer unique DNA sequence
cagcaatgagcaagccccgt

SEQ ID NO: 3432 - DNA, 20 bp, Artificial
  20-mer unique DNA sequence
gaacgcagggagaatgggca

SEQ ID NO: 3433 - DNA, 20 bp, Artificial
  20-mer unique DNA sequence
cgtaactagacgtgccggcg

SEQ ID NO: 3434 - DNA, 20 bp, Artificial
  20-mer unique DNA sequence
attcacgtccggcccaagca

SEQ ID NO: 3435 - DNA, 20 bp, Artificial
  20-mer unique DNA sequence
tctcaccgcgccgaacatct

SEQ ID NO: 3436 - DNA, 20 bp, Artificial
  20-mer unique DNA sequence
ttgcactccagcacgatccc

SEQ ID NO: 3437 - DNA, 20 bp, Artificial
  20-mer unique DNA sequence
gcttgaccgcggatttcccg

SEQ ID NO: 3438 - DNA, 20 bp, Artificial
  20-mer unique DNA sequence
acggcgctgttcgtaccatg

SEQ ID NO: 3439 - DNA, 20 bp, Artificial
  20-mer unique DNA sequence
gccaaacgcatcaggcatcc

SEQ ID NO: 3440 - DNA, 20 bp, Artificial
  20-mer unique DNA sequence
gtgcggctatacctgggatg

SEQ ID NO: 3441 - DNA, 20 bp, Artificial
  20-mer unique DNA sequence
tagtgggcagggtgagaggc

SEQ ID NO: 3442 - DNA, 20 bp, Artificial
  20-mer unique DNA sequence
tccagtaccccgcttgccac

SEQ ID NO: 3443 - DNA, 20 bp, Artificial
  20-mer unique DNA sequence
tgccgtgccccagatagtcc

SEQ ID NO: 3444 - DNA, 20 bp, Artificial
  20-mer unique DNA sequence
catgctcttgtcgtgggccg

SEQ ID NO: 3445 - DNA, 20 bp, Artificial
  20-mer unique DNA sequence
tgttggccctcccctgtcat

SEQ ID NO: 3446 - DNA, 20 bp, Artificial
  20-mer unique DNA sequence
ccccccctagaataaccgcg

SEQ ID NO: 3447 - DNA, 20 bp, Artificial
  20-mer unique DNA sequence
accttggttacgcggtcgct

SEQ ID NO: 3448 - DNA, 20 bp, Artificial
  20-mer unique DNA sequence
tagcacatggcggggggttg

SEQ ID NO: 3449 - DNA, 20 bp, Artificial
  20-mer unique DNA sequence
tacccggaacgcgactgcac

SEQ ID NO: 3450 - DNA, 20 bp, Artificial
  20-mer unique DNA sequence
tggttgggcgttcgggagta

SEQ ID NO: 3451 - DNA, 20 bp, Artificial
  20-mer unique DNA sequence
gcctgcttattcgggccaag

SEQ ID NO: 3452 - DNA, 20 bp, Artificial
  20-mer unique DNA sequence
gggcctccgaaaatctgctg

SEQ ID NO: 3453 - DNA, 20 bp, Artificial
  20-mer unique DNA sequence
cgggcaacgagcagaagcag

SEQ ID NO: 3454 - DNA, 20 bp, Artificial
  20-mer unique DNA sequence
cccaatcaggtttcgtgcca

SEQ ID NO: 3455 - DNA, 20 bp, Artificial
  20-mer unique DNA sequence
caggccgtagcccaaccatg

SEQ ID NO: 3456 - DNA, 20 bp, Artificial
  20-mer unique DNA sequence
cggggaacagctgagttgga

SEQ ID NO: 3457 - DNA, 20 bp, Artificial
  20-mer unique DNA sequence
ctgattcgataccgggcggc

SEQ ID NO: 3458 - DNA, 20 bp, Artificial
  20-mer unique DNA sequence
agtgacaccgatgagggcgg

SEQ ID NO: 3459 - DNA, 20 bp, Artificial
  20-mer unique DNA sequence
gggacccaccccattgtctg

SEQ ID NO: 3460 - DNA, 20 bp, Artificial
  20-mer unique DNA sequence
ccctcccgcacaagcaaggt

SEQ ID NO: 3461 - DNA, 20 bp, Artificial
  20-mer unique DNA sequence
tcctcctttcgcttcccacg

SEQ ID NO: 3462 - DNA, 20 bp, Artificial
  20-mer unique DNA sequence
aaatcccccacgcgcagaac

SEQ ID NO: 3463 - DNA, 20 bp, Artificial
  20-mer unique DNA sequence
tgcgttttgatgacccccga

SEQ ID NO: 3464 - DNA, 20 bp, Artificial
  20-mer unique DNA sequence
ggtatggcttttccccgcgt

SEQ ID NO: 3465 - DNA, 20 bp, Artificial
  20-mer unique DNA sequence
ttccatgtcttccgcgctcc

SEQ ID NO: 3466 - DNA, 20 bp, Artificial
  20-mer unique DNA sequence
aatggaacgggaagctgcgg

SEQ ID NO: 3467 - DNA, 20 bp, Artificial
  20-mer unique DNA sequence
cacggcgggatgaataaggc

SEQ ID NO: 3468 - DNA, 20 bp, Artificial
  20-mer unique DNA sequence
gcaggttgctacagagtgcg

SEQ ID NO: 3469 - DNA, 20 bp, Artificial
  20-mer unique DNA sequence
ctccacctttacccgaccgc

SEQ ID NO: 3470 - DNA, 20 bp, Artificial
  20-mer unique DNA sequence
gttggcgtgggtggtctggt

SEQ ID NO: 3471 - DNA, 20 bp, Artificial
  20-mer unique DNA sequence
gcgaaggcgagttgggggta

SEQ ID NO: 3472 - DNA, 20 bp, Artificial
  20-mer unique DNA sequence
gcccgtacccacaccattgc

SEQ ID NO: 3473 - DNA, 20 bp, Artificial
  20-mer unique DNA sequence
ctttgcgcgaggtggaggtt

SEQ ID NO: 3474 - DNA, 20 bp, Artificial
  20-mer unique DNA sequence
tccacattttgcccccccag

SEQ ID NO: 3475 - DNA, 20 bp, Artificial
  20-mer unique DNA sequence
ggcaacaagcagggggtgtg

SEQ ID NO: 3476 - DNA, 20 bp, Artificial
  20-mer unique DNA sequence
tgctcaaccgtccgcatccc

SEQ ID NO: 3477 - DNA, 20 bp, Artificial
  20-mer unique DNA sequence
gccctataggacctcccccg

SEQ ID NO: 3478 - DNA, 20 bp, Artificial
  20-mer unique DNA sequence
tactggacggaacgagcggg

SEQ ID NO: 3479 - DNA, 20 bp, Artificial
  20-mer unique DNA sequence
ctggctaggctggggggttt

SEQ ID NO: 3480 - DNA, 20 bp, Artificial
  20-mer unique DNA sequence
caagaggaatacgcccggca

SEQ ID NO: 3481 - DNA, 20 bp, Artificial
  20-mer unique DNA sequence
caccccgacgtgcgagaact

SEQ ID NO: 3482 - DNA, 20 bp, Artificial
  20-mer unique DNA sequence
tccctttttcccctcatgca

SEQ ID NO: 3483 - DNA, 20 bp, Artificial
  20-mer unique DNA sequence
tttcgctgggccgtttttct

SEQ ID NO: 3484 - DNA, 20 bp, Artificial
  20-mer unique DNA sequence
gcacgtaggccgggttcacc

SEQ ID NO: 3485 - DNA, 20 bp, Artificial
  20-mer unique DNA sequence
ttattcgcctccgaccccct

SEQ ID NO: 3486 - DNA, 20 bp, Artificial
  20-mer unique DNA sequence
ctagacgaggctggcgcgga

SEQ ID NO: 3487 - DNA, 20 bp, Artificial
  20-mer unique DNA sequence
tatttgggaaacggcgcgtg

SEQ ID NO: 3488 - DNA, 20 bp, Artificial
  20-mer unique DNA sequence
gggggacgacagagcgggac

SEQ ID NO: 3489 - DNA, 20 bp, Artificial
  20-mer unique DNA sequence
tacccgtttcgcttgccgtc

SEQ ID NO: 3490 - DNA, 20 bp, Artificial
  20-mer unique DNA sequence
ggataggtttggggggctgc

SEQ ID NO: 3491 - DNA, 20 bp, Artificial
  20-mer unique DNA sequence
acccgagaatgccccaatgc

SEQ ID NO: 3492 - DNA, 20 bp, Artificial
  20-mer unique DNA sequence
gcccacattacgtccccagg

SEQ ID NO: 3493 - DNA, 20 bp, Artificial
  20-mer unique DNA sequence
tgccaaaagggtaccgccac

SEQ ID NO: 3494 - DNA, 20 bp, Artificial
  20-mer unique DNA sequence
gacaacgctggtcgggtggc

SEQ ID NO: 3495 - DNA, 20 bp, Artificial
  20-mer unique DNA sequence
acacacccacgcctggaacg

SEQ ID NO: 3496 - DNA, 20 bp, Artificial
  20-mer unique DNA sequence
gcttcatcccgaaccgacct

SEQ ID NO: 3497 - DNA, 20 bp, Artificial
  20-mer unique DNA sequence
ccccgtagctgtcccctcag

SEQ ID NO: 3498 - DNA, 20 bp, Artificial
  20-mer unique DNA sequence
agacgcgacccgtcaagtca

SEQ ID NO: 3499 - DNA, 20 bp, Artificial
  20-mer unique DNA sequence
atcaccagagcactccgggt

SEQ ID NO: 3500 - DNA, 20 bp, Artificial
  20-mer unique DNA sequence
gaggccgggattaggggtgt

SEQ ID NO: 3501 - DNA, 20 bp, Artificial
  20-mer unique DNA sequence
cacgaactagcacgaggccg

SEQ ID NO: 3502 - DNA, 20 bp, Artificial
  20-mer unique DNA sequence
gctgggaaatcgcggcccta

SEQ ID NO: 3503 - DNA, 20 bp, Artificial
  20-mer unique DNA sequence
cctaccacatcctggcgcgg

SEQ ID NO: 3504 - DNA, 20 bp, Artificial
  20-mer unique DNA sequence
accggccgtcccaagttcat

SEQ ID NO: 3505 - DNA, 20 bp, Artificial
  20-mer unique DNA sequence
gattggggcgacggttgggt

SEQ ID NO: 3506 - DNA, 20 bp, Artificial
  20-mer unique DNA sequence
cgcctaacgcaagggagaca

SEQ ID NO: 3507 - DNA, 20 bp, Artificial
  20-mer unique DNA sequence
ccgccccttcctggtcattc

SEQ ID NO: 3508 - DNA, 20 bp, Artificial
  20-mer unique DNA sequence
caggcaggggtaagtccggc

SEQ ID NO: 3509 - DNA, 20 bp, Artificial
  20-mer unique DNA sequence
tcggattccttttgcgggtc

SEQ ID NO: 3510 - DNA, 20 bp, Artificial
  20-mer unique DNA sequence
caaccggccgctgacatttc

SEQ ID NO: 3511 - DNA, 20 bp, Artificial
  20-mer unique DNA sequence
cggattcgtttgggcgtgac

SEQ ID NO: 3512 - DNA, 20 bp, Artificial
  20-mer unique DNA sequence
atccgctcgagattggtccg

SEQ ID NO: 3513 - DNA, 20 bp, Artificial
  20-mer unique DNA sequence
tttgggtgcaccgcttcagg

SEQ ID NO: 3514 - DNA, 20 bp, Artificial
  20-mer unique DNA sequence
agatcggcaatgtcagcggc

SEQ ID NO: 3515 - DNA, 20 bp, Artificial
  20-mer unique DNA sequence
gcgtcgtgctcatacgttcc

SEQ ID NO: 3516 - DNA, 20 bp, Artificial
  20-mer unique DNA sequence
tacttggctgctgacggcgg

SEQ ID NO: 3517 - DNA, 20 bp, Artificial
  20-mer unique DNA sequence
ttctctttcgggggctagcg

SEQ ID NO: 3518 - DNA, 20 bp, Artificial
  20-mer unique DNA sequence
aaaagcaggagtggagggca

SEQ ID NO: 3519 - DNA, 20 bp, Artificial
  20-mer unique DNA sequence
aggcccatccaccagtccca

SEQ ID NO: 3520 - DNA, 20 bp, Artificial
  20-mer unique DNA sequence
gtatcagggacgggagcggc

SEQ ID NO: 3521 - DNA, 20 bp, Artificial
  20-mer unique DNA sequence
taggacccccgcacatcacc

SEQ ID NO: 3522 - DNA, 20 bp, Artificial
  20-mer unique DNA sequence
tctggcgcggttgtgattct

SEQ ID NO: 3523 - DNA, 20 bp, Artificial
  20-mer unique DNA sequence
ttctgtgcttcgcggctctc

SEQ ID NO: 3524 - DNA, 20 bp, Artificial
  20-mer unique DNA sequence
cacttaatccgggcggtgca

SEQ ID NO: 3525 - DNA, 20 bp, Artificial
  20-mer unique DNA sequence
gccgttttcccgagtctgca

SEQ ID NO: 3526 - DNA, 20 bp, Artificial
  20-mer unique DNA sequence
acagagccgtgcgctcaaga

SEQ ID NO: 3527 - DNA, 20 bp, Artificial
  20-mer unique DNA sequence
tcgcgtcgcgcctctactaa

SEQ ID NO: 3528 - DNA, 20 bp, Artificial
  20-mer unique DNA sequence
caggtggggtggacgtcgag

SEQ ID NO: 3529 - DNA, 20 bp, Artificial
  20-mer unique DNA sequence
cgcgcgggtgaatgtaaaaa

SEQ ID NO: 3530 - DNA, 20 bp, Artificial
  20-mer unique DNA sequence
tggcagtgagtgggtggata

SEQ ID NO: 3531 - DNA, 20 bp, Artificial
  20-mer unique DNA sequence
gccacgataagcaccgggat

SEQ ID NO: 3532 - DNA, 20 bp, Artificial
  20-mer unique DNA sequence
tgcacctaccggccaccctg

SEQ ID NO: 3533 - DNA, 20 bp, Artificial
  20-mer unique DNA sequence
tcgagcccccagcccaatct

SEQ ID NO: 3534 - DNA, 20 bp, Artificial
  20-mer unique DNA sequence
gtgtgggtctccggctcgat

SEQ ID NO: 3535 - DNA, 20 bp, Artificial
  20-mer unique DNA sequence
cccgggatcgatattgagcg

SEQ ID NO: 3536 - DNA, 20 bp, Artificial
  20-mer unique DNA sequence
cccaaacccctcctctcccg

SEQ ID NO: 3537 - DNA, 20 bp, Artificial
  20-mer unique DNA sequence
tgggtcggattggttgggtt

SEQ ID NO: 3538 - DNA, 20 bp, Artificial
  20-mer unique DNA sequence
tcctgtttgtgggggttgcg

SEQ ID NO: 3539 - DNA, 20 bp, Artificial
  20-mer unique DNA sequence
ggctgtaaagtgggggacga

SEQ ID NO: 3540 - DNA, 20 bp, Artificial
  20-mer unique DNA sequence
gcggtctgtgctttcccttc

SEQ ID NO: 3541 - DNA, 20 bp, Artificial
  20-mer unique DNA sequence
gggagccggaaagagcgaca

SEQ ID NO: 3542 - DNA, 20 bp, Artificial
  20-mer unique DNA sequence
tcccactttcgcctccccgt

SEQ ID NO: 3543 - DNA, 20 bp, Artificial
  20-mer unique DNA sequence
tgtgtccccgtccgctctcc

SEQ ID NO: 3544 - DNA, 20 bp, Artificial
  20-mer unique DNA sequence
ataattccgtgaggcggcga

SEQ ID NO: 3545 - DNA, 20 bp, Artificial
  20-mer unique DNA sequence
acttgcttctcccaccctcg

SEQ ID NO: 3546 - DNA, 20 bp, Artificial
  20-mer unique DNA sequence
acgaattgggaggcggcggt

SEQ ID NO: 3547 - DNA, 20 bp, Artificial
  20-mer unique DNA sequence
ccttttccgaggcgcttcta

SEQ ID NO: 3548 - DNA, 20 bp, Artificial
  20-mer unique DNA sequence
gggatccggccagttcatga

SEQ ID NO: 3549 - DNA, 20 bp, Artificial
  20-mer unique DNA sequence
cggtggtggtgggtcgctat

SEQ ID NO: 3550 - DNA, 20 bp, Artificial
  20-mer unique DNA sequence
tattcaccgtcctcccccga

SEQ ID NO: 3551 - DNA, 20 bp, Artificial
  20-mer unique DNA sequence
gggaggggaatgggggacta

SEQ ID NO: 3552 - DNA, 20 bp, Artificial
  20-mer unique DNA sequence
cgacaggtcactcgcgtact

SEQ ID NO: 3553 - DNA, 20 bp, Artificial
  20-mer unique DNA sequence
acccaccccgcttacatccc

SEQ ID NO: 3554 - DNA, 20 bp, Artificial
  20-mer unique DNA sequence
gttgagtgagatgcggcggc

SEQ ID NO: 3555 - DNA, 20 bp, Artificial
  20-mer unique DNA sequence
atccccgcccatccagatca

SEQ ID NO: 3556 - DNA, 20 bp, Artificial
  20-mer unique DNA sequence
acgcctcactgcgagagaaa

SEQ ID NO: 3557 - DNA, 20 bp, Artificial
  20-mer unique DNA sequence
gcctgaaaaccgatgtgggg

SEQ ID NO: 3558 - DNA, 20 bp, Artificial
  20-mer unique DNA sequence
gtgcccgcaggttggtatcc

SEQ ID NO: 3559 - DNA, 20 bp, Artificial
  20-mer unique DNA sequence
ttatacgggtcggcggaagg

SEQ ID NO: 3560 - DNA, 20 bp, Artificial
  20-mer unique DNA sequence
tgacgacccctcctcccatg

SEQ ID NO: 3561 - DNA, 20 bp, Artificial
  20-mer unique DNA sequence
agcggctactaacgccatgt

SEQ ID NO: 3562 - DNA, 20 bp, Artificial
  20-mer unique DNA sequence
cccgcccacagccaagagaa

SEQ ID NO: 3563 - DNA, 20 bp, Artificial
  20-mer unique DNA sequence
ggcagggcgcatcgaagtac

SEQ ID NO: 3564 - DNA, 20 bp, Artificial
  20-mer unique DNA sequence
gcacgtggagcacagaaggg

SEQ ID NO: 3565 - DNA, 20 bp, Artificial
  20-mer unique DNA sequence
ccctagctggcactttcccg

SEQ ID NO: 3566 - DNA, 20 bp, Artificial
  20-mer unique DNA sequence
cgggtcggttaggctgctgg

SEQ ID NO: 3567 - DNA, 20 bp, Artificial
  20-mer unique DNA sequence
cgccgctggatgtggagagg

SEQ ID NO: 3568 - DNA, 20 bp, Artificial
  20-mer unique DNA sequence
acgacggctggctagttgcg

SEQ ID NO: 3569 - DNA, 20 bp, Artificial
  20-mer unique DNA sequence
aaacctttcatgcggcccgg

SEQ ID NO: 3570 - DNA, 20 bp, Artificial
  20-mer unique DNA sequence
taccacaagacgacggggca

SEQ ID NO: 3571 - DNA, 20 bp, Artificial
  20-mer unique DNA sequence
tccccggcgttttcattctc

SEQ ID NO: 3572 - DNA, 20 bp, Artificial
  20-mer unique DNA sequence
gcgtgggccgaagtgatgct

SEQ ID NO: 3573 - DNA, 20 bp, Artificial
  20-mer unique DNA sequence
attttccacaaggcccccca

SEQ ID NO: 3574 - DNA, 20 bp, Artificial
  20-mer unique DNA sequence
cttggctcgggtcgggatac

SEQ ID NO: 3575 - DNA, 20 bp, Artificial
  20-mer unique DNA sequence
gttctgtccgccccctcacc

SEQ ID NO: 3576 - DNA, 20 bp, Artificial
  20-mer unique DNA sequence
aatggggcagtggtcggaga

SEQ ID NO: 3577 - DNA, 20 bp, Artificial
  20-mer unique DNA sequence
ggctcgggatttcattggca

SEQ ID NO: 3578 - DNA, 20 bp, Artificial
  20-mer unique DNA sequence
gggcaccagagccagcagtt

SEQ ID NO: 3579 - DNA, 20 bp, Artificial
  20-mer unique DNA sequence
gcttggtgagtggcgtcggt

SEQ ID NO: 3580 - DNA, 20 bp, Artificial
  20-mer unique DNA sequence
tacagtgcatggaagggcgg

SEQ ID NO: 3581 - DNA, 20 bp, Artificial
  20-mer unique DNA sequence
tgcatccaacccacgtcgaa

SEQ ID NO: 3582 - DNA, 20 bp, Artificial
  20-mer unique DNA sequence
taagcacgccgccgaagaaa

SEQ ID NO: 3583 - DNA, 20 bp, Artificial
  20-mer unique DNA sequence
ggttcccattgcctgcccta

SEQ ID NO: 3584 - DNA, 20 bp, Artificial
  20-mer unique DNA sequence
acacggagcgagggaggaaa

SEQ ID NO: 3585 - DNA, 20 bp, Artificial
  20-mer unique DNA sequence
ccatggcgcgctaactttcc

SEQ ID NO: 3586 - DNA, 20 bp, Artificial
  20-mer unique DNA sequence
tcgctggggtctggtcaatg

SEQ ID NO: 3587 - DNA, 20 bp, Artificial
  20-mer unique DNA sequence
ttccaacgcctcccaacctg

SEQ ID NO: 3588 - DNA, 20 bp, Artificial
  20-mer unique DNA sequence
cgaccttaattccgcgccct

SEQ ID NO: 3589 - DNA, 20 bp, Artificial
  20-mer unique DNA sequence
tccccccccgtcatgttggt

SEQ ID NO: 3590 - DNA, 20 bp, Artificial
  20-mer unique DNA sequence
tgaacctcctcgcccctgat

SEQ ID NO: 3591 - DNA, 20 bp, Artificial
  20-mer unique DNA sequence
cgtaccccatgcccttgcgt

SEQ ID NO: 3592 - DNA, 20 bp, Artificial
  20-mer unique DNA sequence
ttacgtaccccagcgcccac

SEQ ID NO: 3593 - DNA, 20 bp, Artificial
  20-mer unique DNA sequence
atatctcttgcccgccgtcg

SEQ ID NO: 3594 - DNA, 20 bp, Artificial
  20-mer unique DNA sequence
acgccccaacacgaaggaag

SEQ ID NO: 3595 - DNA, 20 bp, Artificial
  20-mer unique DNA sequence
tccccatctctgcctccgac

SEQ ID NO: 3596 - DNA, 20 bp, Artificial
  20-mer unique DNA sequence
cccaacccaggaggccaatc

SEQ ID NO: 3597 - DNA, 20 bp, Artificial
  20-mer unique DNA sequence
agtcggtggtgcgttcgtgc

SEQ ID NO: 3598 - DNA, 20 bp, Artificial
  20-mer unique DNA sequence
tacgcgcttcatccggcaat

SEQ ID NO: 3599 - DNA, 20 bp, Artificial
  20-mer unique DNA sequence
taccgcatgcaaccgggaac

SEQ ID NO: 3600 - DNA, 20 bp, Artificial
  20-mer unique DNA sequence
tgcctcgccaccgttttacg

SEQ ID NO: 3601 - DNA, 20 bp, Artificial
  20-mer unique DNA sequence
cggaaccccccccaaaatat

SEQ ID NO: 3602 - DNA, 20 bp, Artificial
  20-mer unique DNA sequence
tgtctgtggcctcgctggat

SEQ ID NO: 3603 - DNA, 20 bp, Artificial
  20-mer unique DNA sequence
tgcagcgacaccccggatac

SEQ ID NO: 3604 - DNA, 20 bp, Artificial
  20-mer unique DNA sequence
cctggccgggctttttgaga

SEQ ID NO: 3605 - DNA, 20 bp, Artificial
  20-mer unique DNA sequence
gtgcggcgcgcttttttgtc

SEQ ID NO: 3606 - DNA, 20 bp, Artificial
  20-mer unique DNA sequence
gcgcgggtgtctgtgattgg

SEQ ID NO: 3607 - DNA, 20 bp, Artificial
  20-mer unique DNA sequence
cgttcgggggttgctgcctt

SEQ ID NO: 3608 - DNA, 20 bp, Artificial
  20-mer unique DNA sequence
ttgtttccggtcccgtaggg

SEQ ID NO: 3609 - DNA, 20 bp, Artificial
  20-mer unique DNA sequence
gccgctttactgcgttcccc

SEQ ID NO: 3610 - DNA, 20 bp, Artificial
  20-mer unique DNA sequence
tctaatctttccccccccat

SEQ ID NO: 3611 - DNA, 20 bp, Artificial
  20-mer unique DNA sequence
cggctccccatccacaaagg

SEQ ID NO: 3612 - DNA, 20 bp, Artificial
  20-mer unique DNA sequence
ggagcctcatgccaccgtct

SEQ ID NO: 3613 - DNA, 20 bp, Artificial
  20-mer unique DNA sequence
ctgcccagcctgccctagat

SEQ ID NO: 3614 - DNA, 20 bp, Artificial
  20-mer unique DNA sequence
agatccctgaatgacgccgc

SEQ ID NO: 3615 - DNA, 20 bp, Artificial
  20-mer unique DNA sequence
cgttggggtgggttcgaatg

SEQ ID NO: 3616 - DNA, 20 bp, Artificial
  20-mer unique DNA sequence
tttgaccccgcacttcccag

SEQ ID NO: 3617 - DNA, 20 bp, Artificial
  20-mer unique DNA sequence
caaagggtccggccgaagtt

SEQ ID NO: 3618 - DNA, 20 bp, Artificial
  20-mer unique DNA sequence
tcccctcccacgtcattgcc

SEQ ID NO: 3619 - DNA, 20 bp, Artificial
  20-mer unique DNA sequence
gtgccgtgtcccttgtccga

SEQ ID NO: 3620 - DNA, 20 bp, Artificial
  20-mer unique DNA sequence
cgacacagacatcccgaccg

SEQ ID NO: 3621 - DNA, 20 bp, Artificial
  20-mer unique DNA sequence
tgtaaccccccagccacgat

SEQ ID NO: 3622 - DNA, 20 bp, Artificial
  20-mer unique DNA sequence
cgcacgcgtattggggatct

SEQ ID NO: 3623 - DNA, 20 bp, Artificial
  20-mer unique DNA sequence
cgacggaacaagtgagcggg

SEQ ID NO: 3624 - DNA, 20 bp, Artificial
  20-mer unique DNA sequence
ccacgatggggggtgttcaa

SEQ ID NO: 3625 - DNA, 20 bp, Artificial
  20-mer unique DNA sequence
tcgggtgtctgcgggaaagc

SEQ ID NO: 3626 - DNA, 20 bp, Artificial
  20-mer unique DNA sequence
gggggtggggtggctaattg

SEQ ID NO: 3627 - DNA, 20 bp, Artificial
  20-mer unique DNA sequence
tcctctgggcgtcttgcaaa

SEQ ID NO: 3628 - DNA, 20 bp, Artificial
  20-mer unique DNA sequence
ctgggaataagccccccccc

SEQ ID NO: 3629 - DNA, 20 bp, Artificial
  20-mer unique DNA sequence
cggaagtaaacaacgcgggc

SEQ ID NO: 3630 - DNA, 20 bp, Artificial
  20-mer unique DNA sequence
gggcattggattggcagagg

SEQ ID NO: 3631 - DNA, 20 bp, Artificial
  20-mer unique DNA sequence
gttgcaaccccccagcctct

SEQ ID NO: 3632 - DNA, 20 bp, Artificial
  20-mer unique DNA sequence
atgccactattcccttcgcc

SEQ ID NO: 3633 - DNA, 20 bp, Artificial
  20-mer unique DNA sequence
cgacgggtgcaactctccaa

SEQ ID NO: 3634 - DNA, 20 bp, Artificial
  20-mer unique DNA sequence
tgctcgccgttttacgaccg

SEQ ID NO: 3635 - DNA, 20 bp, Artificial
  20-mer unique DNA sequence
tcgctatcgacgcccttgtg

SEQ ID NO: 3636 - DNA, 20 bp, Artificial
  20-mer unique DNA sequence
tcggctgcttcttttgcggt

SEQ ID NO: 3637 - DNA, 20 bp, Artificial
  20-mer unique DNA sequence
ttccgtggtgcgtgttgtcg

SEQ ID NO: 3638 - DNA, 20 bp, Artificial
  20-mer unique DNA sequence
cgctccacgcccctctacat

SEQ ID NO: 3639 - DNA, 20 bp, Artificial
  20-mer unique DNA sequence
tggaggcggggcttggattt

SEQ ID NO: 3640 - DNA, 20 bp, Artificial
  20-mer unique DNA sequence
ggtggggctggctgttattg

SEQ ID NO: 3641 - DNA, 20 bp, Artificial
  20-mer unique DNA sequence
ttgggcggacgggtacttct

SEQ ID NO: 3642 - DNA, 20 bp, Artificial
  20-mer unique DNA sequence
cagaacctgccaaagggccc

SEQ ID NO: 3643 - DNA, 20 bp, Artificial
  20-mer unique DNA sequence
acgtgtgtcgtggcaatact

SEQ ID NO: 3644 - DNA, 20 bp, Artificial
  20-mer unique DNA sequence
cagcctaccgcggacacaaa

SEQ ID NO: 3645 - DNA, 20 bp, Artificial
  20-mer unique DNA sequence
aaatgttcgcacgctcccgc

SEQ ID NO: 3646 - DNA, 20 bp, Artificial
  20-mer unique DNA sequence
catgctttgcgaacgggctt

SEQ ID NO: 3647 - DNA, 20 bp, Artificial
  20-mer unique DNA sequence
cggttcggctcctcgtctca

SEQ ID NO: 3648 - DNA, 20 bp, Artificial
  20-mer unique DNA sequence
acaggcgggagaggagaggg

SEQ ID NO: 3649 - DNA, 20 bp, Artificial
  20-mer unique DNA sequence
tcggggctggggactgacaa

SEQ ID NO: 3650 - DNA, 20 bp, Artificial
  20-mer unique DNA sequence
tttcgtccccacaaccccat

SEQ ID NO: 3651 - DNA, 20 bp, Artificial
  20-mer unique DNA sequence
ggtggcaaacgggctgagaa

SEQ ID NO: 3652 - DNA, 20 bp, Artificial
  20-mer unique DNA sequence
cggaaaccaagccgcaaagc

SEQ ID NO: 3653 - DNA, 20 bp, Artificial
  20-mer unique DNA sequence
cgcacgcctacataccgccc

SEQ ID NO: 3654 - DNA, 20 bp, Artificial
  20-mer unique DNA sequence
tagctagcaggcgtgtccct

SEQ ID NO: 3655 - DNA, 20 bp, Artificial
  20-mer unique DNA sequence
cacggcaaacccagaccgaa

SEQ ID NO: 3656 - DNA, 20 bp, Artificial
  20-mer unique DNA sequence
gccctcgtacagcccatctt

SEQ ID NO: 3657 - DNA, 20 bp, Artificial
  20-mer unique DNA sequence
ccggtctcgcctttggttgt

SEQ ID NO: 3658 - DNA, 20 bp, Artificial
  20-mer unique DNA sequence
ctgcacaagccgcgaaagtc

SEQ ID NO: 3659 - DNA, 20 bp, Artificial
  20-mer unique DNA sequence
atgaaccaaacgcgcacccc

SEQ ID NO: 3660 - DNA, 20 bp, Artificial
  20-mer unique DNA sequence
caaaaccgccaacagcacgc

SEQ ID NO: 3661 - DNA, 20 bp, Artificial
  20-mer unique DNA sequence
ggagggatcggccatgacaa

SEQ ID NO: 3662 - DNA, 20 bp, Artificial
  20-mer unique DNA sequence
cggaagaggggggacacgag

SEQ ID NO: 3663 - DNA, 20 bp, Artificial
  20-mer unique DNA sequence
cgcacgcctaaccgaaacct

SEQ ID NO: 3664 - DNA, 20 bp, Artificial
  20-mer unique DNA sequence
gagacccacctcaggcgacc

SEQ ID NO: 3665 - DNA, 20 bp, Artificial
  20-mer unique DNA sequence
tgagaatagatgcgccgccc

SEQ ID NO: 3666 - DNA, 20 bp, Artificial
  20-mer unique DNA sequence
caagattcggccgcgggtag

SEQ ID NO: 3667 - DNA, 20 bp, Artificial
  20-mer unique DNA sequence
tcgtcacccgccttacccat

SEQ ID NO: 3668 - DNA, 20 bp, Artificial
  20-mer unique DNA sequence
acgcaaggcccagcaaacag

SEQ ID NO: 3669 - DNA, 20 bp, Artificial
  20-mer unique DNA sequence
cgacggactaccccccacat

SEQ ID NO: 3670 - DNA, 20 bp, Artificial
  20-mer unique DNA sequence
tgtggatggtgctgggatgc

SEQ ID NO: 3671 - DNA, 20 bp, Artificial
  20-mer unique DNA sequence
gccctcccacacgacatcca

SEQ ID NO: 3672 - DNA, 20 bp, Artificial
  20-mer unique DNA sequence
ccccatgcagaaaaacgccg

SEQ ID NO: 3673 - DNA, 20 bp, Artificial
  20-mer unique DNA sequence
ccccccagcggactcaaaga

SEQ ID NO: 3674 - DNA, 20 bp, Artificial
  20-mer unique DNA sequence
cattcgtatccgccttccgc

SEQ ID NO: 3675 - DNA, 20 bp, Artificial
  20-mer unique DNA sequence
accattgccaccccgttccg

SEQ ID NO: 3676 - DNA, 20 bp, Artificial
  20-mer unique DNA sequence
tgcttcctacgcgctagcct

SEQ ID NO: 3677 - DNA, 20 bp, Artificial
  20-mer unique DNA sequence
gatgaaccggtcgtcgcttg

SEQ ID NO: 3678 - DNA, 20 bp, Artificial
  20-mer unique DNA sequence
aggctcacccgaacgcgaat

SEQ ID NO: 3679 - DNA, 20 bp, Artificial
  20-mer unique DNA sequence
attctacgtagcggggccgg

SEQ ID NO: 3680 - DNA, 20 bp, Artificial
  20-mer unique DNA sequence
ccgcagcaacaacagccatc

SEQ ID NO: 3681 - DNA, 20 bp, Artificial
  20-mer unique DNA sequence
ccccgaaggcagcaggatga

SEQ ID NO: 3682 - DNA, 20 bp, Artificial
  20-mer unique DNA sequence
gtgccatacacaagacgggc

SEQ ID NO: 3683 - DNA, 20 bp, Artificial
  20-mer unique DNA sequence
aagctagtgaccggccccca

SEQ ID NO: 3684 - DNA, 20 bp, Artificial
  20-mer unique DNA sequence
tcgatggtcacgccacttgt

SEQ ID NO: 3685 - DNA, 20 bp, Artificial
  20-mer unique DNA sequence
gtaggtttcggctccgggaa

SEQ ID NO: 3686 - DNA, 20 bp, Artificial
  20-mer unique DNA sequence
ctgagaagtatgccgcggga

SEQ ID NO: 3687 - DNA, 20 bp, Artificial
  20-mer unique DNA sequence
accgtttcgcccattcttgc

SEQ ID NO: 3688 - DNA, 20 bp, Artificial
  20-mer unique DNA sequence
tcaataaggtcccgcccccc

SEQ ID NO: 3689 - DNA, 20 bp, Artificial
  20-mer unique DNA sequence
ccccctcctgccgaacaatc

SEQ ID NO: 3690 - DNA, 20 bp, Artificial
  20-mer unique DNA sequence
aggcagcgacacatcaccgg

SEQ ID NO: 3691 - DNA, 20 bp, Artificial
  20-mer unique DNA sequence
ttttcgtgtgtggggggtgc

SEQ ID NO: 3692 - DNA, 20 bp, Artificial
  20-mer unique DNA sequence
tattgactgcccgctgccgg

SEQ ID NO: 3693 - DNA, 20 bp, Artificial
  20-mer unique DNA sequence
ccccgcatccaggccacata

SEQ ID NO: 3694 - DNA, 20 bp, Artificial
  20-mer unique DNA sequence
ccatgttcgacgcccctgcg

SEQ ID NO: 3695 - DNA, 20 bp, Artificial
  20-mer unique DNA sequence
cgatgggttggacgagcagt

SEQ ID NO: 3696 - DNA, 20 bp, Artificial
  20-mer unique DNA sequence
gacccggaaagcgtctgtgc

SEQ ID NO: 3697 - DNA, 20 bp, Artificial
  20-mer unique DNA sequence
cgggtcgctcttcaggtgca

SEQ ID NO: 3698 - DNA, 20 bp, Artificial
  20-mer unique DNA sequence
acaacgacctgacccacgca

SEQ ID NO: 3699 - DNA, 20 bp, Artificial
  20-mer unique DNA sequence
aacacaggcaccacggtagg

SEQ ID NO: 3700 - DNA, 20 bp, Artificial
  20-mer unique DNA sequence
gcgtgaggatgtggagcgga

SEQ ID NO: 3701 - DNA, 20 bp, Artificial
  20-mer unique DNA sequence
tcccggcgagcaaacacaca

SEQ ID NO: 3702 - DNA, 20 bp, Artificial
  20-mer unique DNA sequence
ccgcaaccacacaaacgctg

SEQ ID NO: 3703 - DNA, 20 bp, Artificial
  20-mer unique DNA sequence
acaaggggtaaatcgggggg

SEQ ID NO: 3704 - DNA, 20 bp, Artificial
  20-mer unique DNA sequence
gctgacccgttctttgcgcg

SEQ ID NO: 3705 - DNA, 20 bp, Artificial
  20-mer unique DNA sequence
cctcaagcgcgtgtcccata

SEQ ID NO: 3706 - DNA, 20 bp, Artificial
  20-mer unique DNA sequence
cgtgggcggcaggtacgttt

SEQ ID NO: 3707 - DNA, 20 bp, Artificial
  20-mer unique DNA sequence
gccgccgcaaatcagctcta

SEQ ID NO: 3708 - DNA, 20 bp, Artificial
  20-mer unique DNA sequence
cgggcggctaagatggtcaa

SEQ ID NO: 3709 - DNA, 20 bp, Artificial
  20-mer unique DNA sequence
cacccctcgccattcgttga

SEQ ID NO: 3710 - DNA, 20 bp, Artificial
  20-mer unique DNA sequence
cgaacctgcgcccacaatca

SEQ ID NO: 3711 - DNA, 20 bp, Artificial
  20-mer unique DNA sequence
gccccaaaatccatagccca

SEQ ID NO: 3712 - DNA, 20 bp, Artificial
  20-mer unique DNA sequence
catgcacgtggcgactcatc

SEQ ID NO: 3713 - DNA, 20 bp, Artificial
  20-mer unique DNA sequence
aaattcccaccgtatcgccg

SEQ ID NO: 3714 - DNA, 20 bp, Artificial
  20-mer unique DNA sequence
tgcgatgacaggttggggag

SEQ ID NO: 3715 - DNA, 20 bp, Artificial
  20-mer unique DNA sequence
agcatgtaccgcgtttgggg

SEQ ID NO: 3716 - DNA, 20 bp, Artificial
  20-mer unique DNA sequence
tgctcgtgggctggactgga

SEQ ID NO: 3717 - DNA, 20 bp, Artificial
  20-mer unique DNA sequence
taacccagcgcgcctaacct

SEQ ID NO: 3718 - DNA, 20 bp, Artificial
  20-mer unique DNA sequence
cgggctcggactgcaggaag

SEQ ID NO: 3719 - DNA, 20 bp, Artificial
  20-mer unique DNA sequence
cggtgccccagtaaaaaggc

SEQ ID NO: 3720 - DNA, 20 bp, Artificial
  20-mer unique DNA sequence
ttctttcccgccccaccgat

SEQ ID NO: 3721 - DNA, 20 bp, Artificial
  20-mer unique DNA sequence
tccttcgccaccaccaccaa

SEQ ID NO: 3722 - DNA, 20 bp, Artificial
  20-mer unique DNA sequence
catcagtcgaacgcaggcgg

SEQ ID NO: 3723 - DNA, 20 bp, Artificial
  20-mer unique DNA sequence
gacagggcaccgatgacacg

SEQ ID NO: 3724 - DNA, 20 bp, Artificial
  20-mer unique DNA sequence
cacccaaccaaccatcgcaa

SEQ ID NO: 3725 - DNA, 20 bp, Artificial
  20-mer unique DNA sequence
agggccgggatagggtgagt

SEQ ID NO: 3726 - DNA, 20 bp, Artificial
  20-mer unique DNA sequence
cgtagggtaaggatgccgcc

SEQ ID NO: 3727 - DNA, 20 bp, Artificial
  20-mer unique DNA sequence
ttaccccgcgctgttgtgca

SEQ ID NO: 3728 - DNA, 20 bp, Artificial
  20-mer unique DNA sequence
gcaaaactccggctgcagct

SEQ ID NO: 3729 - DNA, 20 bp, Artificial
  20-mer unique DNA sequence
gcgacaaaaaccgcctcgga

SEQ ID NO: 3730 - DNA, 20 bp, Artificial
  20-mer unique DNA sequence
gaacccacccccagcacaag

SEQ ID NO: 3731 - DNA, 20 bp, Artificial
  20-mer unique DNA sequence
tcaacccgaaccactccccg

SEQ ID NO: 3732 - DNA, 20 bp, Artificial
  20-mer unique DNA sequence
cgcgcgggttaactgaggtg

SEQ ID NO: 3733 - DNA, 20 bp, Artificial
  20-mer unique DNA sequence
tgcccgataaccgctcccct

SEQ ID NO: 3734 - DNA, 20 bp, Artificial
  20-mer unique DNA sequence
ccacacctgccgattcctcg

SEQ ID NO: 3735 - DNA, 20 bp, Artificial
  20-mer unique DNA sequence
catacacccgacttgcccga

SEQ ID NO: 3736 - DNA, 20 bp, Artificial
  20-mer unique DNA sequence
catccgtgcccttcgttgct

SEQ ID NO: 3737 - DNA, 20 bp, Artificial
  20-mer unique DNA sequence
cgccgaccgatacacaacgc

SEQ ID NO: 3738 - DNA, 20 bp, Artificial
  20-mer unique DNA sequence
accgagggcttggggacacc

SEQ ID NO: 3739 - DNA, 20 bp, Artificial
  20-mer unique DNA sequence
ccgaccccacgatggaaaat

SEQ ID NO: 3740 - DNA, 20 bp, Artificial
  20-mer unique DNA sequence
attctttggcttgcgaggcg

SEQ ID NO: 3741 - DNA, 20 bp, Artificial
  20-mer unique DNA sequence
cgccacctccagccgaaact

SEQ ID NO: 3742 - DNA, 20 bp, Artificial
  20-mer unique DNA sequence
gcactggcgtgtaagcagac

SEQ ID NO: 3743 - DNA, 20 bp, Artificial
  20-mer unique DNA sequence
acttggagtgccccgaagag

SEQ ID NO: 3744 - DNA, 20 bp, Artificial
  20-mer unique DNA sequence
aaagcggggcaggactacgg

SEQ ID NO: 3745 - DNA, 20 bp, Artificial
  20-mer unique DNA sequence
cgcagggtgaggggaggagg

SEQ ID NO: 3746 - DNA, 20 bp, Artificial
  20-mer unique DNA sequence
gggcacgggggggataagtc

SEQ ID NO: 3747 - DNA, 20 bp, Artificial
  20-mer unique DNA sequence
cactccgcacctccgttcac

SEQ ID NO: 3748 - DNA, 20 bp, Artificial
  20-mer unique DNA sequence
gaatcgggaagggcgggaaa

SEQ ID NO: 3749 - DNA, 20 bp, Artificial
  20-mer unique DNA sequence
tgggcaggcggtaggggttc

SEQ ID NO: 3750 - DNA, 20 bp, Artificial
  20-mer unique DNA sequence
cagcccctaacgaagccacc

SEQ ID NO: 3751 - DNA, 20 bp, Artificial
  20-mer unique DNA sequence
tccccacccctcagtccaag

SEQ ID NO: 3752 - DNA, 20 bp, Artificial
  20-mer unique DNA sequence
ccaggtgcgcgggttgacat

SEQ ID NO: 3753 - DNA, 20 bp, Artificial
  20-mer unique DNA sequence
aatacgttccggcgacccct

SEQ ID NO: 3754 - DNA, 20 bp, Artificial
  20-mer unique DNA sequence
ccaaggggggcgattcaaca

SEQ ID NO: 3755 - DNA, 20 bp, Artificial
  20-mer unique DNA sequence
tgggccttttccggtctggg

SEQ ID NO: 3756 - DNA, 20 bp, Artificial
  20-mer unique DNA sequence
gttggcgggtcttcgtctcg

SEQ ID NO: 3757 - DNA, 20 bp, Artificial
  20-mer unique DNA sequence
cctaccgcgattggccagtt

SEQ ID NO: 3758 - DNA, 20 bp, Artificial
  20-mer unique DNA sequence
cgggcaccgagtgtagtgtt

SEQ ID NO: 3759 - DNA, 20 bp, Artificial
  20-mer unique DNA sequence
gcgcagggccaaaacattct

SEQ ID NO: 3760 - DNA, 20 bp, Artificial
  20-mer unique DNA sequence
agcgcgcgaggcaaaaagtg

SEQ ID NO: 3761 - DNA, 20 bp, Artificial
  20-mer unique DNA sequence
gtcgtggaggtgccgtgatg

SEQ ID NO: 3762 - DNA, 20 bp, Artificial
  20-mer unique DNA sequence
tggcatgcgcgggaactttc

SEQ ID NO: 3763 - DNA, 20 bp, Artificial
  20-mer unique DNA sequence
gccctcttggcggatcaatc

SEQ ID NO: 3764 - DNA, 20 bp, Artificial
  20-mer unique DNA sequence
cagcgtgcggcctcaatcta

SEQ ID NO: 3765 - DNA, 20 bp, Artificial
  20-mer unique DNA sequence
ggccaaaccgcactccattt

SEQ ID NO: 3766 - DNA, 20 bp, Artificial
  20-mer unique DNA sequence
tgggtagcgtgtgtggcgtt

SEQ ID NO: 3767 - DNA, 20 bp, Artificial
  20-mer unique DNA sequence
ccacctcccgcacgacttca

SEQ ID NO: 3768 - DNA, 20 bp, Artificial
  20-mer unique DNA sequence
cagggtgtgagccaatcgaa

SEQ ID NO: 3769 - DNA, 20 bp, Artificial
  20-mer unique DNA sequence
agggcggacttcttgggcta

SEQ ID NO: 3770 - DNA, 20 bp, Artificial
  20-mer unique DNA sequence
caccacgaccgaaccacgca

SEQ ID NO: 3771 - DNA, 20 bp, Artificial
  20-mer unique DNA sequence
tcccctcgtgtttgcttgcg

SEQ ID NO: 3772 - DNA, 20 bp, Artificial
  20-mer unique DNA sequence
tcggaaagcggcggtgaata

SEQ ID NO: 3773 - DNA, 20 bp, Artificial
  20-mer unique DNA sequence
atcaacccccgtcaggccaa

SEQ ID NO: 3774 - DNA, 20 bp, Artificial
  20-mer unique DNA sequence
aacggaaagaaacgcgacgg

SEQ ID NO: 3775 - DNA, 20 bp, Artificial
  20-mer unique DNA sequence
gctcgctactgccctctcgc

SEQ ID NO: 3776 - DNA, 20 bp, Artificial
  20-mer unique DNA sequence
ttgccatccagtccatccgg

SEQ ID NO: 3777 - DNA, 20 bp, Artificial
  20-mer unique DNA sequence
tcctcgccagcctcctgaac

SEQ ID NO: 3778 - DNA, 20 bp, Artificial
  20-mer unique DNA sequence
aggcaaccggcgagcatcac

SEQ ID NO: 3779 - DNA, 20 bp, Artificial
  20-mer unique DNA sequence
tgcggaccataagcgggttg

SEQ ID NO: 3780 - DNA, 20 bp, Artificial
  20-mer unique DNA sequence
atacggcagatgcgtacccg

SEQ ID NO: 3781 - DNA, 20 bp, Artificial
  20-mer unique DNA sequence
ggtgcattggggttaggggg

SEQ ID NO: 3782 - DNA, 20 bp, Artificial
  20-mer unique DNA sequence
cccggcgtcaacttttcctg

SEQ ID NO: 3783 - DNA, 20 bp, Artificial
  20-mer unique DNA sequence
cgaccccctaagatgacgcg

SEQ ID NO: 3784 - DNA, 20 bp, Artificial
  20-mer unique DNA sequence
aaacgccccctcacttcccg

SEQ ID NO: 3785 - DNA, 20 bp, Artificial
  20-mer unique DNA sequence
agaatttgaagcgcgggacg

SEQ ID NO: 3786 - DNA, 20 bp, Artificial
  20-mer unique DNA sequence
ccattcgcacgagtcctcca

SEQ ID NO: 3787 - DNA, 20 bp, Artificial
  20-mer unique DNA sequence
gcaaaggcgcatcacctcag

SEQ ID NO: 3788 - DNA, 20 bp, Artificial
  20-mer unique DNA sequence
gccaagtcaaaccgccgtcc

SEQ ID NO: 3789 - DNA, 20 bp, Artificial
  20-mer unique DNA sequence
ttacctccgtgacctgcccc

SEQ ID NO: 3790 - DNA, 20 bp, Artificial
  20-mer unique DNA sequence
aaaccatgcggcctcaaccc

SEQ ID NO: 3791 - DNA, 20 bp, Artificial
  20-mer unique DNA sequence
ccccggacacctacgagccc

SEQ ID NO: 3792 - DNA, 20 bp, Artificial
  20-mer unique DNA sequence
tggactgaaccgatcgctcg

SEQ ID NO: 3793 - DNA, 20 bp, Artificial
  20-mer unique DNA sequence
aaagccgcgcctaatgaacg

SEQ ID NO: 3794 - DNA, 20 bp, Artificial
  20-mer unique DNA sequence
agggctgtgccgggagtggt

SEQ ID NO: 3795 - DNA, 20 bp, Artificial
  20-mer unique DNA sequence
ccctcaccaccgccgtaatg

SEQ ID NO: 3796 - DNA, 20 bp, Artificial
  20-mer unique DNA sequence
aggaggtggggcgagacatg

SEQ ID NO: 3797 - DNA, 20 bp, Artificial
  20-mer unique DNA sequence
tgcccccacataccctcaca

SEQ ID NO: 3798 - DNA, 20 bp, Artificial
  20-mer unique DNA sequence
cgttcgtcccttagcgctcg

SEQ ID NO: 3799 - DNA, 20 bp, Artificial
  20-mer unique DNA sequence
gcccggcctcagcaacacac

SEQ ID NO: 3800 - DNA, 20 bp, Artificial
  20-mer unique DNA sequence
ccggcaagcattggatggtg

SEQ ID NO: 3801 - DNA, 20 bp, Artificial
  20-mer unique DNA sequence
agagggctccggttgaaggg

SEQ ID NO: 3802 - DNA, 20 bp, Artificial
  20-mer unique DNA sequence
gcgtgggggagtttggcatt

SEQ ID NO: 3803 - DNA, 20 bp, Artificial
  20-mer unique DNA sequence
ctaaagccaccaacccccgc

SEQ ID NO: 3804 - DNA, 20 bp, Artificial
  20-mer unique DNA sequence
agcttattcgcgccctcccc

SEQ ID NO: 3805 - DNA, 20 bp, Artificial
  20-mer unique DNA sequence
gcccatccgtccttgcaatc

SEQ ID NO: 3806 - DNA, 20 bp, Artificial
  20-mer unique DNA sequence
cgcacgaactaacgccccca

SEQ ID NO: 3807 - DNA, 20 bp, Artificial
  20-mer unique DNA sequence
ccagttccgggggccttatc

SEQ ID NO: 3808 - DNA, 20 bp, Artificial
  20-mer unique DNA sequence
gttaatcgggcagacgggga

SEQ ID NO: 3809 - DNA, 20 bp, Artificial
  20-mer unique DNA sequence
acccgttctccgtctgccaa

SEQ ID NO: 3810 - DNA, 20 bp, Artificial
  20-mer unique DNA sequence
gcagccgcaccccattaagg

SEQ ID NO: 3811 - DNA, 20 bp, Artificial
  20-mer unique DNA sequence
cggccacgagggaagaacgg

SEQ ID NO: 3812 - DNA, 20 bp, Artificial
  20-mer unique DNA sequence
ggggtaccaggcagcgattc

SEQ ID NO: 3813 - DNA, 20 bp, Artificial
  20-mer unique DNA sequence
atgcgggcagggaaaagcag

SEQ ID NO: 3814 - DNA, 20 bp, Artificial
  20-mer unique DNA sequence
ttcgcgaactgtcggagcac

SEQ ID NO: 3815 - DNA, 20 bp, Artificial
  20-mer unique DNA sequence
atagccacggctcactaggc

SEQ ID NO: 3816 - DNA, 20 bp, Artificial
  20-mer unique DNA sequence
ccatctgcgcccttccaaca

SEQ ID NO: 3817 - DNA, 20 bp, Artificial
  20-mer unique DNA sequence
acggccgcgctgacaactat

SEQ ID NO: 3818 - DNA, 20 bp, Artificial
  20-mer unique DNA sequence
cacgcaatccctgagtccga

SEQ ID NO: 3819 - DNA, 20 bp, Artificial
  20-mer unique DNA sequence
cttcgcggaggggttaggta

SEQ ID NO: 3820 - DNA, 20 bp, Artificial
  20-mer unique DNA sequence
tttagtcccgccaacgtccg

SEQ ID NO: 3821 - DNA, 20 bp, Artificial
  20-mer unique DNA sequence
aatcagccgtgacccgtagc

SEQ ID NO: 3822 - DNA, 20 bp, Artificial
  20-mer unique DNA sequence
cagcgtggttttcggcggtc

SEQ ID NO: 3823 - DNA, 20 bp, Artificial
  20-mer unique DNA sequence
ttgtctgccggcccccattt

SEQ ID NO: 3824 - DNA, 20 bp, Artificial
  20-mer unique DNA sequence
aacgggcggcgagacactca

SEQ ID NO: 3825 - DNA, 20 bp, Artificial
  20-mer unique DNA sequence
tgccgggttggtgcttggtc

SEQ ID NO: 3826 - DNA, 20 bp, Artificial
  20-mer unique DNA sequence
gtgagcctggtgtgttgcgg

SEQ ID NO: 3827 - DNA, 20 bp, Artificial
  20-mer unique DNA sequence
tgcctctcctgcctcacccc

SEQ ID NO: 3828 - DNA, 20 bp, Artificial
  20-mer unique DNA sequence
gcggccgacgaaaccttagc

SEQ ID NO: 3829 - DNA, 20 bp, Artificial
  20-mer unique DNA sequence
agggcaggcacgacgagagg

SEQ ID NO: 3830 - DNA, 20 bp, Artificial
  20-mer unique DNA sequence
gcccccgtctgtccgataaa

SEQ ID NO: 3831 - DNA, 20 bp, Artificial
  20-mer unique DNA sequence
ggatatcgatgcgggcgtgg

SEQ ID NO: 3832 - DNA, 20 bp, Artificial
  20-mer unique DNA sequence
gttcgcaggtgggcttcgct

SEQ ID NO: 3833 - DNA, 20 bp, Artificial
  20-mer unique DNA sequence
ccccataacaaggcgaagcc

SEQ ID NO: 3834 - DNA, 20 bp, Artificial
  20-mer unique DNA sequence
aacccgatacgctgtcccgg

SEQ ID NO: 3835 - DNA, 20 bp, Artificial
  20-mer unique DNA sequence
ctgcaaacgcggggctaaca

SEQ ID NO: 3836 - DNA, 20 bp, Artificial
  20-mer unique DNA sequence
ggcaaaagatccgcacacgg

SEQ ID NO: 3837 - DNA, 20 bp, Artificial
  20-mer unique DNA sequence
tgccgtgccgtcatctctga

SEQ ID NO: 3838 - DNA, 20 bp, Artificial
  20-mer unique DNA sequence
gatagcggaattgcgcaggg

SEQ ID NO: 3839 - DNA, 20 bp, Artificial
  20-mer unique DNA sequence
acccgttggcggaagagtca

SEQ ID NO: 3840 - DNA, 20 bp, Artificial
  20-mer unique DNA sequence
cgcacgccccagtcaagaac

SEQ ID NO: 3841 - DNA, 20 bp, Artificial
  20-mer unique DNA sequence
ggggcagagggggttagggc

SEQ ID NO: 3842 - DNA, 20 bp, Artificial
  20-mer unique DNA sequence
tgtgtgagggtgggtgcgga

SEQ ID NO: 3843 - DNA, 20 bp, Artificial
  20-mer unique DNA sequence
actttgccccacgaccgaaa

SEQ ID NO: 3844 - DNA, 20 bp, Artificial
  20-mer unique DNA sequence
gttgcgcatgtgacagctcc

SEQ ID NO: 3845 - DNA, 20 bp, Artificial
  20-mer unique DNA sequence
cgcgctcagcctagagtaca

SEQ ID NO: 3846 - DNA, 20 bp, Artificial
  20-mer unique DNA sequence
atgcgcacctaggtcagtcc

SEQ ID NO: 3847 - DNA, 20 bp, Artificial
  20-mer unique DNA sequence
aacggtcggtcccggatttt

SEQ ID NO: 3848 - DNA, 20 bp, Artificial
  20-mer unique DNA sequence
gccatggggagccgggaata

SEQ ID NO: 3849 - DNA, 20 bp, Artificial
  20-mer unique DNA sequence
gccggtgtttgcaggatggc

SEQ ID NO: 3850 - DNA, 20 bp, Artificial
  20-mer unique DNA sequence
catgcgccaaccctctgtgt

SEQ ID NO: 3851 - DNA, 20 bp, Artificial
  20-mer unique DNA sequence
cgcgggaacgaagcctggat

SEQ ID NO: 3852 - DNA, 20 bp, Artificial
  20-mer unique DNA sequence
aacccacccaccacaaggca

SEQ ID NO: 3853 - DNA, 20 bp, Artificial
  20-mer unique DNA sequence
aacgaagtggcgaggcgaga

SEQ ID NO: 3854 - DNA, 20 bp, Artificial
  20-mer unique DNA sequence
atccgtccgctgcccaactt

SEQ ID NO: 3855 - DNA, 20 bp, Artificial
  20-mer unique DNA sequence
aaaatggcggcaagacggtt

SEQ ID NO: 3856 - DNA, 20 bp, Artificial
  20-mer unique DNA sequence
gacaatcgcgagggaaacgg

SEQ ID NO: 3857 - DNA, 20 bp, Artificial
  20-mer unique DNA sequence
tggtgggttgacgtcgagcg

SEQ ID NO: 3858 - DNA, 20 bp, Artificial
  20-mer unique DNA sequence
cctaggccggcgttcttgct

SEQ ID NO: 3859 - DNA, 20 bp, Artificial
  20-mer unique DNA sequence
tgcgttggcgtaggtgtcgg

SEQ ID NO: 3860 - DNA, 20 bp, Artificial
  20-mer unique DNA sequence
actctgaccgccccccgact

SEQ ID NO: 3861 - DNA, 20 bp, Artificial
  20-mer unique DNA sequence
tcgtccagagttcaccgccc

SEQ ID NO: 3862 - DNA, 20 bp, Artificial
  20-mer unique DNA sequence
tgagatgggggaacgaggct

SEQ ID NO: 3863 - DNA, 20 bp, Artificial
  20-mer unique DNA sequence
tgctgtgggggcgtattcca

SEQ ID NO: 3864 - DNA, 20 bp, Artificial
  20-mer unique DNA sequence
ccgcacccatacaacgccct

SEQ ID NO: 3865 - DNA, 20 bp, Artificial
  20-mer unique DNA sequence
tcccacaatccgacacgccc

SEQ ID NO: 3866 - DNA, 20 bp, Artificial
  20-mer unique DNA sequence
ctacgcgcgcaaggatggat

SEQ ID NO: 3867 - DNA, 20 bp, Artificial
  20-mer unique DNA sequence
tcgccgcaaatcgtccttga

SEQ ID NO: 3868 - DNA, 20 bp, Artificial
  20-mer unique DNA sequence
ccagtccaccaccgcaggaa

SEQ ID NO: 3869 - DNA, 20 bp, Artificial
  20-mer unique DNA sequence
tggacaacctaccgcagcgc

SEQ ID NO: 3870 - DNA, 20 bp, Artificial
  20-mer unique DNA sequence
gcccctcaaaccacgatcgc

SEQ ID NO: 3871 - DNA, 20 bp, Artificial
  20-mer unique DNA sequence
tatccccgccctcgtcccat

SEQ ID NO: 3872 - DNA, 20 bp, Artificial
  20-mer unique DNA sequence
gcagatggaggaacgagggg

SEQ ID NO: 3873 - DNA, 20 bp, Artificial
  20-mer unique DNA sequence
agcaggtctaaccggtccgt

SEQ ID NO: 3874 - DNA, 20 bp, Artificial
  20-mer unique DNA sequence
cctgtattgcgcgttccggg

SEQ ID NO: 3875 - DNA, 20 bp, Artificial
  20-mer unique DNA sequence
aaccacgcgatccaccaacg

SEQ ID NO: 3876 - DNA, 20 bp, Artificial
  20-mer unique DNA sequence
acgccctagaccctcgccac

SEQ ID NO: 3877 - DNA, 20 bp, Artificial
  20-mer unique DNA sequence
ggctgcgtaatccgtgcgtg

SEQ ID NO: 3878 - DNA, 20 bp, Artificial
  20-mer unique DNA sequence
agaaacgtcaaccggctccg

SEQ ID NO: 3879 - DNA, 20 bp, Artificial
  20-mer unique DNA sequence
ccgggccgttagcattgaga

SEQ ID NO: 3880 - DNA, 20 bp, Artificial
  20-mer unique DNA sequence
accccaaacggcaacctcag

SEQ ID NO: 3881 - DNA, 20 bp, Artificial
  20-mer unique DNA sequence
tatgaacgggggcgggagga

SEQ ID NO: 3882 - DNA, 20 bp, Artificial
  20-mer unique DNA sequence
aaacacccgacccccagcat

SEQ ID NO: 3883 - DNA, 20 bp, Artificial
  20-mer unique DNA sequence
ataacgcattgggccgggaa

SEQ ID NO: 3884 - DNA, 20 bp, Artificial
  20-mer unique DNA sequence
tggccccttactccccgcag

SEQ ID NO: 3885 - DNA, 20 bp, Artificial
  20-mer unique DNA sequence
ggaggcacacgcatggggta

SEQ ID NO: 3886 - DNA, 20 bp, Artificial
  20-mer unique DNA sequence
ggggaaggcgctacgtcaac

SEQ ID NO: 3887 - DNA, 20 bp, Artificial
  20-mer unique DNA sequence
aaggtgcatttgggcggtga

SEQ ID NO: 3888 - DNA, 20 bp, Artificial
  20-mer unique DNA sequence
tccaagggttccgtccacca

SEQ ID NO: 3889 - DNA, 20 bp, Artificial
  20-mer unique DNA sequence
tggttaggcgtggagtggcg

SEQ ID NO: 3890 - DNA, 20 bp, Artificial
  20-mer unique DNA sequence
taagggagtgatcgggcggg

SEQ ID NO: 3891 - DNA, 20 bp, Artificial
  20-mer unique DNA sequence
tggggcatgcggatcgttat

SEQ ID NO: 3892 - DNA, 20 bp, Artificial
  20-mer unique DNA sequence
cgtttggcccttggtttcga

SEQ ID NO: 3893 - DNA, 20 bp, Artificial
  20-mer unique DNA sequence
gagccggcaccacaatacca

SEQ ID NO: 3894 - DNA, 20 bp, Artificial
  20-mer unique DNA sequence
ctaagggtctggtggcgtgc

SEQ ID NO: 3895 - DNA, 20 bp, Artificial
  20-mer unique DNA sequence
ggtccccgaaattgcacgtc

SEQ ID NO: 3896 - DNA, 20 bp, Artificial
  20-mer unique DNA sequence
actttcaccaacccggccag

SEQ ID NO: 3897 - DNA, 20 bp, Artificial
  20-mer unique DNA sequence
taaggttctatcgcccacgt

SEQ ID NO: 3898 - DNA, 20 bp, Artificial
  20-mer unique DNA sequence
ttcctgcatgttggcgctca

SEQ ID NO: 3899 - DNA, 20 bp, Artificial
  20-mer unique DNA sequence
acggcccctagtccctcgca

SEQ ID NO: 3900 - DNA, 20 bp, Artificial
  20-mer unique DNA sequence
ggggcgtgcttgttttacgg

SEQ ID NO: 3901 - DNA, 20 bp, Artificial
  20-mer unique DNA sequence
ggggggcagaagacaaggga

SEQ ID NO: 3902 - DNA, 20 bp, Artificial
  20-mer unique DNA sequence
gtttttcctccccgcctcct

SEQ ID NO: 3903 - DNA, 20 bp, Artificial
  20-mer unique DNA sequence
accatcgaagcaccgcgacc

SEQ ID NO: 3904 - DNA, 20 bp, Artificial
  20-mer unique DNA sequence
gcgtttggtctttgggcagg

SEQ ID NO: 3905 - DNA, 20 bp, Artificial
  20-mer unique DNA sequence
ctggctggtcgggtgttcgc

SEQ ID NO: 3906 - DNA, 20 bp, Artificial
  20-mer unique DNA sequence
ccccgtggattggcgtatgt

SEQ ID NO: 3907 - DNA, 20 bp, Artificial
  20-mer unique DNA sequence
cggagctgcgatttgtggtg

SEQ ID NO: 3908 - DNA, 20 bp, Artificial
  20-mer unique DNA sequence
tgaaggctgaaaccggggtc

SEQ ID NO: 3909 - DNA, 20 bp, Artificial
  20-mer unique DNA sequence
ttgtcgcatgtcctccccac

SEQ ID NO: 3910 - DNA, 20 bp, Artificial
  20-mer unique DNA sequence
aagcaacgccggaccaagca

SEQ ID NO: 3911 - DNA, 20 bp, Artificial
  20-mer unique DNA sequence
agaggttttggccggcgtgt

SEQ ID NO: 3912 - DNA, 20 bp, Artificial
  20-mer unique DNA sequence
gagctggactgcagaccgtt

SEQ ID NO: 3913 - DNA, 20 bp, Artificial
  20-mer unique DNA sequence
tcaacggaccgaacgtgcca

SEQ ID NO: 3914 - DNA, 20 bp, Artificial
  20-mer unique DNA sequence
tattttaccacgcctccgca

SEQ ID NO: 3915 - DNA, 20 bp, Artificial
  20-mer unique DNA sequence
ttttgggggttttgacgcgg

SEQ ID NO: 3916 - DNA, 20 bp, Artificial
  20-mer unique DNA sequence
ccgcatcgacaagcccaagg

SEQ ID NO: 3917 - DNA, 20 bp, Artificial
  20-mer unique DNA sequence
tgggaccctttgggggaaat

SEQ ID NO: 3918 - DNA, 20 bp, Artificial
  20-mer unique DNA sequence
tggtattcccgcgggttttc

SEQ ID NO: 3919 - DNA, 20 bp, Artificial
  20-mer unique DNA sequence
taggatgatgtcgccccggt

SEQ ID NO: 3920 - DNA, 20 bp, Artificial
  20-mer unique DNA sequence
cattccacccagaagcccga

SEQ ID NO: 3921 - DNA, 20 bp, Artificial
  20-mer unique DNA sequence
cctctctggcacgtcgttca

SEQ ID NO: 3922 - DNA, 20 bp, Artificial
  20-mer unique DNA sequence
agacgtctcgactctgctgc

SEQ ID NO: 3923 - DNA, 20 bp, Artificial
  20-mer unique DNA sequence
cacgcccggctagctgtaat

SEQ ID NO: 3924 - DNA, 20 bp, Artificial
  20-mer unique DNA sequence
ccgttgctctattgcgtgcg

SEQ ID NO: 3925 - DNA, 20 bp, Artificial
  20-mer unique DNA sequence
cccagctcgttctcgcccta

SEQ ID NO: 3926 - DNA, 20 bp, Artificial
  20-mer unique DNA sequence
ttctacaaccaatgccgccg

SEQ ID NO: 3927 - DNA, 20 bp, Artificial
  20-mer unique DNA sequence
gccccctgtccgccgtaaaa

SEQ ID NO: 3928 - DNA, 20 bp, Artificial
  20-mer unique DNA sequence
cccccccttttcccagatcc

SEQ ID NO: 3929 - DNA, 20 bp, Artificial
  20-mer unique DNA sequence
tcagagggcggtcaggatgc

SEQ ID NO: 3930 - DNA, 20 bp, Artificial
  20-mer unique DNA sequence
cacacgcattcctccgctcc

SEQ ID NO: 3931 - DNA, 20 bp, Artificial
  20-mer unique DNA sequence
tcgcccaagccaagcacctt

SEQ ID NO: 3932 - DNA, 20 bp, Artificial
  20-mer unique DNA sequence
caccccatggatttcgcgaa

SEQ ID NO: 3933 - DNA, 20 bp, Artificial
  20-mer unique DNA sequence
gtaacacggcggagtcggca

SEQ ID NO: 3934 - DNA, 20 bp, Artificial
  20-mer unique DNA sequence
tcattgccccctagtccgct

SEQ ID NO: 3935 - DNA, 20 bp, Artificial
  20-mer unique DNA sequence
tgtacaatgtgcggcgggag

SEQ ID NO: 3936 - DNA, 20 bp, Artificial
  20-mer unique DNA sequence
cagccttgccgtcgtatccc

SEQ ID NO: 3937 - DNA, 20 bp, Artificial
  20-mer unique DNA sequence
caaccgccgtcctcccttta

SEQ ID NO: 3938 - DNA, 20 bp, Artificial
  20-mer unique DNA sequence
gtagttggccgcgaccccgt

SEQ ID NO: 3939 - DNA, 20 bp, Artificial
  20-mer unique DNA sequence
gagggggtgacgcatgaggc

SEQ ID NO: 3940 - DNA, 20 bp, Artificial
  20-mer unique DNA sequence
tgaggacgaggtgcggaaca

SEQ ID NO: 3941 - DNA, 20 bp, Artificial
  20-mer unique DNA sequence
gcagtcggggggtggtaggt

SEQ ID NO: 3942 - DNA, 20 bp, Artificial
  20-mer unique DNA sequence
cccggtcctcaatcagcgct

SEQ ID NO: 3943 - DNA, 20 bp, Artificial
  20-mer unique DNA sequence
cagtggcgtgggagaggagc

SEQ ID NO: 3944 - DNA, 20 bp, Artificial
  20-mer unique DNA sequence
cccgccctaacatcccgacc

SEQ ID NO: 3945 - DNA, 20 bp, Artificial
  20-mer unique DNA sequence
gcccctgtctccttcgcaac

SEQ ID NO: 3946 - DNA, 20 bp, Artificial
  20-mer unique DNA sequence
ttagttggggagtcgcggat

SEQ ID NO: 3947 - DNA, 20 bp, Artificial
  20-mer unique DNA sequence
ggacctacgccggctttttg

SEQ ID NO: 3948 - DNA, 20 bp, Artificial
  20-mer unique DNA sequence
tggagcttggttcagggggt

SEQ ID NO: 3949 - DNA, 20 bp, Artificial
  20-mer unique DNA sequence
cgcacccagctcctttccac

SEQ ID NO: 3950 - DNA, 20 bp, Artificial
  20-mer unique DNA sequence
acatgggagggggtttgcgt

SEQ ID NO: 3951 - DNA, 20 bp, Artificial
  20-mer unique DNA sequence
agtggttttggggttgccgg

SEQ ID NO: 3952 - DNA, 20 bp, Artificial
  20-mer unique DNA sequence
gcaccaccttccgcccatgt

SEQ ID NO: 3953 - DNA, 20 bp, Artificial
  20-mer unique DNA sequence
tagccgagcggtaatcgtgc

SEQ ID NO: 3954 - DNA, 20 bp, Artificial
  20-mer unique DNA sequence
ccttcccgcacaaatctccg

SEQ ID NO: 3955 - DNA, 20 bp, Artificial
  20-mer unique DNA sequence
gaggctgtattgtgcggcgg

SEQ ID NO: 3956 - DNA, 20 bp, Artificial
  20-mer unique DNA sequence
acgtcgccggatttgagccc

SEQ ID NO: 3957 - DNA, 20 bp, Artificial
  20-mer unique DNA sequence
taacccgccactagctcgcc

SEQ ID NO: 3958 - DNA, 20 bp, Artificial
  20-mer unique DNA sequence
cccccgagcgatcaagccat

SEQ ID NO: 3959 - DNA, 20 bp, Artificial
  20-mer unique DNA sequence
ttgactcccctctcgcgcgt

SEQ ID NO: 3960 - DNA, 20 bp, Artificial
  20-mer unique DNA sequence
acgaccgacccacacccact

SEQ ID NO: 3961 - DNA, 20 bp, Artificial
  20-mer unique DNA sequence
gcagacgcctcaaccccatc

SEQ ID NO: 3962 - DNA, 20 bp, Artificial
  20-mer unique DNA sequence
tagggtcgtagcagcgttgg

SEQ ID NO: 3963 - DNA, 20 bp, Artificial
  20-mer unique DNA sequence
accaaaacaggggcgggagg

SEQ ID NO: 3964 - DNA, 20 bp, Artificial
  20-mer unique DNA sequence
ttcacccgcccctatcattc

SEQ ID NO: 3965 - DNA, 20 bp, Artificial
  20-mer unique DNA sequence
ttcctgccgacccttgctct

SEQ ID NO: 3966 - DNA, 20 bp, Artificial
  20-mer unique DNA sequence
ctcccgacgcacaggtttcc

SEQ ID NO: 3967 - DNA, 20 bp, Artificial
  20-mer unique DNA sequence
atccacgggcgccagacaat

SEQ ID NO: 3968 - DNA, 20 bp, Artificial
  20-mer unique DNA sequence
ggctgttttggcgcatcttg

SEQ ID NO: 3969 - DNA, 20 bp, Artificial
  20-mer unique DNA sequence
gttcttcccaccaccgcgtt

SEQ ID NO: 3970 - DNA, 20 bp, Artificial
  20-mer unique DNA sequence
agggaggcttgggcggtaac

SEQ ID NO: 3971 - DNA, 20 bp, Artificial
  20-mer unique DNA sequence
cagcacagggtcaacgggcg

SEQ ID NO: 3972 - DNA, 20 bp, Artificial
  20-mer unique DNA sequence
ggtgtggaaggtggaggcgt

SEQ ID NO: 3973 - DNA, 20 bp, Artificial
  20-mer unique DNA sequence
taagttgggttggcgcgtca

SEQ ID NO: 3974 - DNA, 20 bp, Artificial
  20-mer unique DNA sequence
attcgcgtgacctctgcgag

SEQ ID NO: 3975 - DNA, 20 bp, Artificial
  20-mer unique DNA sequence
ataaatcggtccggcggagg

SEQ ID NO: 3976 - DNA, 20 bp, Artificial
  20-mer unique DNA sequence
cacgggggtagctcggggta

SEQ ID NO: 3977 - DNA, 20 bp, Artificial
  20-mer unique DNA sequence
tcaaggacgctgggactcgg

SEQ ID NO: 3978 - DNA, 20 bp, Artificial
  20-mer unique DNA sequence
catgcgtgacggaagaggga

SEQ ID NO: 3979 - DNA, 20 bp, Artificial
  20-mer unique DNA sequence
cctgtagcggcgaatgtcca

SEQ ID NO: 3980 - DNA, 20 bp, Artificial
  20-mer unique DNA sequence
gcgatctagcgggtagctgt

SEQ ID NO: 3981 - DNA, 20 bp, Artificial
  20-mer unique DNA sequence
agcgaccttagagcggtcac

SEQ ID NO: 3982 - DNA, 20 bp, Artificial
  20-mer unique DNA sequence
ggagggcgcaagtttcaggg

SEQ ID NO: 3983 - DNA, 20 bp, Artificial
  20-mer unique DNA sequence
gtgtcatagcctggccggcg

SEQ ID NO: 3984 - DNA, 20 bp, Artificial
  20-mer unique DNA sequence
cccgcctctctctaccgtcg

SEQ ID NO: 3985 - DNA, 20 bp, Artificial
  20-mer unique DNA sequence
cctcttcgtcttcgggtcgc

SEQ ID NO: 3986 - DNA, 20 bp, Artificial
  20-mer unique DNA sequence
ccaccaccctacgcctcgga

SEQ ID NO: 3987 - DNA, 20 bp, Artificial
  20-mer unique DNA sequence
acgtgagggcttggcggtaa

SEQ ID NO: 3988 - DNA, 20 bp, Artificial
  20-mer unique DNA sequence
actgggaggtacacggcgcg

SEQ ID NO: 3989 - DNA, 20 bp, Artificial
  20-mer unique DNA sequence
tgcatatggtggccgtcgtc

SEQ ID NO: 3990 - DNA, 20 bp, Artificial
  20-mer unique DNA sequence
ccgagaggctacgtgctgaa

SEQ ID NO: 3991 - DNA, 20 bp, Artificial
  20-mer unique DNA sequence
gtacccagacggcacgtcat

SEQ ID NO: 3992 - DNA, 20 bp, Artificial
  20-mer unique DNA sequence
gtccggttagcgttggtgca

SEQ ID NO: 3993 - DNA, 20 bp, Artificial
  20-mer unique DNA sequence
ggaggccccgaggttgtacg

SEQ ID NO: 3994 - DNA, 20 bp, Artificial
  20-mer unique DNA sequence
cctgatactggcagccggga

SEQ ID NO: 3995 - DNA, 20 bp, Artificial
  20-mer unique DNA sequence
agcgcgtttacgaggcgatg

SEQ ID NO: 3996 - DNA, 20 bp, Artificial
  20-mer unique DNA sequence
ctgtcatgcgggccaaaacg

SEQ ID NO: 3997 - DNA, 20 bp, Artificial
  20-mer unique DNA sequence
caccgcatgcctcccctcta

SEQ ID NO: 3998 - DNA, 20 bp, Artificial
  20-mer unique DNA sequence
ccatgtcgggtggctgagga

SEQ ID NO: 3999 - DNA, 20 bp, Artificial
  20-mer unique DNA sequence
tcgcatcgctaattcccgct

SEQ ID NO: 4000 - DNA, 20 bp, Artificial
  20-mer unique DNA sequence
tgccctaccgctttcgcgaa

SEQ ID NO: 4001 - DNA, 20 bp, Artificial
  20-mer unique DNA sequence
ggaaggggcgttgactggtc

SEQ ID NO: 4002 - DNA, 20 bp, Artificial
  20-mer unique DNA sequence
cgcaaccgacccctccgacg

SEQ ID NO: 4003 - DNA, 20 bp, Artificial
  20-mer unique DNA sequence
aacggcgaggggagacacac

SEQ ID NO: 4004 - DNA, 20 bp, Artificial
  20-mer unique DNA sequence
cagaactagcgtaacccggg

SEQ ID NO: 4005 - DNA, 20 bp, Artificial
  20-mer unique DNA sequence
aaggcgcggctaagaagtgg

SEQ ID NO: 4006 - DNA, 20 bp, Artificial
  20-mer unique DNA sequence
tgcattcccgccctccaaaa

SEQ ID NO: 4007 - DNA, 20 bp, Artificial
  20-mer unique DNA sequence
gccctccccacccttcagca

SEQ ID NO: 4008 - DNA, 20 bp, Artificial
  20-mer unique DNA sequence
aatgtcggttcggggaggct

SEQ ID NO: 4009 - DNA, 20 bp, Artificial
  20-mer unique DNA sequence
ggcacgatctggggcatacc

SEQ ID NO: 4010 - DNA, 20 bp, Artificial
  20-mer unique DNA sequence
gcggagttcgggcgtgtcaa

SEQ ID NO: 4011 - DNA, 20 bp, Artificial
  20-mer unique DNA sequence
agcgggtgtggtcggagttt

SEQ ID NO: 4012 - DNA, 20 bp, Artificial
  20-mer unique DNA sequence
ccgtcgctctccaccctcct

SEQ ID NO: 4013 - DNA, 20 bp, Artificial
  20-mer unique DNA sequence
ttcccccgccccgagtttaa

SEQ ID NO: 4014 - DNA, 20 bp, Artificial
  20-mer unique DNA sequence
cgatccgggtccatggctta

SEQ ID NO: 4015 - DNA, 20 bp, Artificial
  20-mer unique DNA sequence
gctctttcgtcgtccccgga

SEQ ID NO: 4016 - DNA, 20 bp, Artificial
  20-mer unique DNA sequence
aaatacgccgcactagcctg

SEQ ID NO: 4017 - DNA, 20 bp, Artificial
  20-mer unique DNA sequence
aacggttcctcttcggcggg

SEQ ID NO: 4018 - DNA, 20 bp, Artificial
  20-mer unique DNA sequence
aagctgaggacccttgtcgg

SEQ ID NO: 4019 - DNA, 20 bp, Artificial
  20-mer unique DNA sequence
cggaatgcccaggcgacata

SEQ ID NO: 4020 - DNA, 20 bp, Artificial
  20-mer unique DNA sequence
cgcaggggacacggatcatg

SEQ ID NO: 4021 - DNA, 20 bp, Artificial
  20-mer unique DNA sequence
tagtgggggcagaccggagt

SEQ ID NO: 4022 - DNA, 20 bp, Artificial
  20-mer unique DNA sequence
aagccaatcgaaggccctgc

SEQ ID NO: 4023 - DNA, 20 bp, Artificial
  20-mer unique DNA sequence
caaccgcagacgcagcaaag

SEQ ID NO: 4024 - DNA, 20 bp, Artificial
  20-mer unique DNA sequence
gcaggcaccctagacgcaat

SEQ ID NO: 4025 - DNA, 20 bp, Artificial
  20-mer unique DNA sequence
ttatagcacgcgtggcgctc

SEQ ID NO: 4026 - DNA, 20 bp, Artificial
  20-mer unique DNA sequence
ggcgaggtaacgaagcggag

SEQ ID NO: 4027 - DNA, 20 bp, Artificial
  20-mer unique DNA sequence
aggaagtgcgggtggaacgc

SEQ ID NO: 4028 - DNA, 20 bp, Artificial
  20-mer unique DNA sequence
tagcccgcctgaacatccgt

SEQ ID NO: 4029 - DNA, 20 bp, Artificial
  20-mer unique DNA sequence
ggctgcaacaacgcggtaag

SEQ ID NO: 4030 - DNA, 20 bp, Artificial
  20-mer unique DNA sequence
attcgtgctggggctgcttt

SEQ ID NO: 4031 - DNA, 20 bp, Artificial
  20-mer unique DNA sequence
gcggcggtgagcattcatgt

SEQ ID NO: 4032 - DNA, 20 bp, Artificial
  20-mer unique DNA sequence
ctctcgctgcccgtcccttc

SEQ ID NO: 4033 - DNA, 20 bp, Artificial
  20-mer unique DNA sequence
tagcccgacaccgcgaacat

SEQ ID NO: 4034 - DNA, 20 bp, Artificial
  20-mer unique DNA sequence
ctgtcgtcgtccgggttggt

SEQ ID NO: 4035 - DNA, 20 bp, Artificial
  20-mer unique DNA sequence
cgcgccgtaggagaaagcat

SEQ ID NO: 4036 - DNA, 20 bp, Artificial
  20-mer unique DNA sequence
cagagcgaagctaggcggga

SEQ ID NO: 4037 - DNA, 20 bp, Artificial
  20-mer unique DNA sequence
ctgggatgaaggggcgcaac

SEQ ID NO: 4038 - DNA, 20 bp, Artificial
  20-mer unique DNA sequence
ggggcgggcggtagtgttct

SEQ ID NO: 4039 - DNA, 20 bp, Artificial
  20-mer unique DNA sequence
gccctgtttttgctgacgat

SEQ ID NO: 4040 - DNA, 20 bp, Artificial
  20-mer unique DNA sequence
gaaggcaggcaggggcgttt

SEQ ID NO: 4041 - DNA, 20 bp, Artificial
  20-mer unique DNA sequence
gggcaagtggagcaggcaag

SEQ ID NO: 4042 - DNA, 20 bp, Artificial
  20-mer unique DNA sequence
acatcccccgctagcccaaa

SEQ ID NO: 4043 - DNA, 20 bp, Artificial
  20-mer unique DNA sequence
acgcgccgaatcaatccatc

SEQ ID NO: 4044 - DNA, 20 bp, Artificial
  20-mer unique DNA sequence
ttacacgttccacccccgcg

SEQ ID NO: 4045 - DNA, 20 bp, Artificial
  20-mer unique DNA sequence
cagctcccccgaacgatcct

SEQ ID NO: 4046 - DNA, 20 bp, Artificial
  20-mer unique DNA sequence
accgccccacccaacttaca

SEQ ID NO: 4047 - DNA, 20 bp, Artificial
  20-mer unique DNA sequence
atcaaagggggggaaggggt

SEQ ID NO: 4048 - DNA, 20 bp, Artificial
  20-mer unique DNA sequence
gcgcctatcacccagaccga

SEQ ID NO: 4049 - DNA, 20 bp, Artificial
  20-mer unique DNA sequence
cacacttcgcgcctcacgtc

SEQ ID NO: 4050 - DNA, 20 bp, Artificial
  20-mer unique DNA sequence
cccgatacccccgaaccagg

SEQ ID NO: 4051 - DNA, 20 bp, Artificial
  20-mer unique DNA sequence
ggtgggcgggggtagagttt

SEQ ID NO: 4052 - DNA, 20 bp, Artificial
  20-mer unique DNA sequence
ctaaccgggggacgcaacga

SEQ ID NO: 4053 - DNA, 20 bp, Artificial
  20-mer unique DNA sequence
caccgtccatgccacctcct

SEQ ID NO: 4054 - DNA, 20 bp, Artificial
  20-mer unique DNA sequence
ccaaagacacgaggggggag

SEQ ID NO: 4055 - DNA, 20 bp, Artificial
  20-mer unique DNA sequence
attagggatgcgggcggagc

SEQ ID NO: 4056 - DNA, 20 bp, Artificial
  20-mer unique DNA sequence
ccatcctccgcgcgttatct

SEQ ID NO: 4057 - DNA, 20 bp, Artificial
  20-mer unique DNA sequence
ggaaaataaggagcccgccg

SEQ ID NO: 4058 - DNA, 20 bp, Artificial
  20-mer unique DNA sequence
ttgaaaaccagtccgcgcac

SEQ ID NO: 4059 - DNA, 20 bp, Artificial
  20-mer unique DNA sequence
tacaaggctggcggaacacg

SEQ ID NO: 4060 - DNA, 20 bp, Artificial
  20-mer unique DNA sequence
ttgctacccggatccaccca

SEQ ID NO: 4061 - DNA, 20 bp, Artificial
  20-mer unique DNA sequence
ttgtcttcgccccgcttgat

SEQ ID NO: 4062 - DNA, 20 bp, Artificial
  20-mer unique DNA sequence
cacatgccaccccggaacaa

SEQ ID NO: 4063 - DNA, 20 bp, Artificial
  20-mer unique DNA sequence
tccagccatacgaaacgggg

SEQ ID NO: 4064 - DNA, 20 bp, Artificial
  20-mer unique DNA sequence
agaattgaggcggcgggaca

SEQ ID NO: 4065 - DNA, 20 bp, Artificial
  20-mer unique DNA sequence
cggtgcctctcccctcccta

SEQ ID NO: 4066 - DNA, 20 bp, Artificial
  20-mer unique DNA sequence
tgcctgtgcgttgggactgt

SEQ ID NO: 4067 - DNA, 20 bp, Artificial
  20-mer unique DNA sequence
cctccgcaatcagccatcct

SEQ ID NO: 4068 - DNA, 20 bp, Artificial
  20-mer unique DNA sequence
acaccaggccgaggaggtca

SEQ ID NO: 4069 - DNA, 20 bp, Artificial
  20-mer unique DNA sequence
tccaacgcgacccctcctag

SEQ ID NO: 4070 - DNA, 20 bp, Artificial
  20-mer unique DNA sequence
tttccgcccttctcaaccga

SEQ ID NO: 4071 - DNA, 20 bp, Artificial
  20-mer unique DNA sequence
gcacggggtggtggcatagt

SEQ ID NO: 4072 - DNA, 20 bp, Artificial
  20-mer unique DNA sequence
agcgttcttggtcggtggca

SEQ ID NO: 4073 - DNA, 20 bp, Artificial
  20-mer unique DNA sequence
gtcccgccccaaatgtcctc

SEQ ID NO: 4074 - DNA, 20 bp, Artificial
  20-mer unique DNA sequence
gacggtgggagaatggcgat

SEQ ID NO: 4075 - DNA, 20 bp, Artificial
  20-mer unique DNA sequence
ccggggctgtcctgtctctg

SEQ ID NO: 4076 - DNA, 20 bp, Artificial
  20-mer unique DNA sequence
gcgttgttcccctgctgtgc

SEQ ID NO: 4077 - DNA, 20 bp, Artificial
  20-mer unique DNA sequence
ggcccaaccaccccaagctc

SEQ ID NO: 4078 - DNA, 20 bp, Artificial
  20-mer unique DNA sequence
caccctcccccaccttacga

SEQ ID NO: 4079 - DNA, 20 bp, Artificial
  20-mer unique DNA sequence
tggggtccgctattgtcccg

SEQ ID NO: 4080 - DNA, 20 bp, Artificial
  20-mer unique DNA sequence
cacctcagaattcgcgtccg

SEQ ID NO: 4081 - DNA, 20 bp, Artificial
  20-mer unique DNA sequence
tgcctctaatcgcgccgtca

SEQ ID NO: 4082 - DNA, 20 bp, Artificial
  20-mer unique DNA sequence
cgagtgcgttgtgggatggg

SEQ ID NO: 4083 - DNA, 20 bp, Artificial
  20-mer unique DNA sequence
tcggtgtgccctctatgcgc

SEQ ID NO: 4084 - DNA, 20 bp, Artificial
  20-mer unique DNA sequence
ccgtggggtgagatggcaaa

SEQ ID NO: 4085 - DNA, 20 bp, Artificial
  20-mer unique DNA sequence
ggatcggtgaggacgggtgg

SEQ ID NO: 4086 - DNA, 20 bp, Artificial
  20-mer unique DNA sequence
atgggagcaggggcaacagg

SEQ ID NO: 4087 - DNA, 20 bp, Artificial
  20-mer unique DNA sequence
gcggcggctgagtcgatctt

SEQ ID NO: 4088 - DNA, 20 bp, Artificial
  20-mer unique DNA sequence
cggctcgggtatttgttggc

SEQ ID NO: 4089 - DNA, 20 bp, Artificial
  20-mer unique DNA sequence
aatcccttgcggctcgtgct

SEQ ID NO: 4090 - DNA, 20 bp, Artificial
  20-mer unique DNA sequence
caccgcaagcagcccgagag

SEQ ID NO: 4091 - DNA, 20 bp, Artificial
  20-mer unique DNA sequence
caagattcacaccgcgtccg

SEQ ID NO: 4092 - DNA, 20 bp, Artificial
  20-mer unique DNA sequence
gatgtatgctcgaggccgcg

SEQ ID NO: 4093 - DNA, 20 bp, Artificial
  20-mer unique DNA sequence
tcttcgcttcctccatggct

SEQ ID NO: 4094 - DNA, 20 bp, Artificial
  20-mer unique DNA sequence
ggatagtgttggcgaggcgc

SEQ ID NO: 4095 - DNA, 20 bp, Artificial
  20-mer unique DNA sequence
aggcgtggaggtattgggaa

SEQ ID NO: 4096 - DNA, 20 bp, Artificial
  20-mer unique DNA sequence
gggactgatagcgtgaggcg

SEQ ID NO: 4097 - DNA, 20 bp, Artificial
  20-mer unique DNA sequence
gggagggcggaggtggctat

SEQ ID NO: 4098 - DNA, 20 bp, Artificial
  20-mer unique DNA sequence
tcggtgcgtcggggactatt

SEQ ID NO: 4099 - DNA, 20 bp, Artificial
  20-mer unique DNA sequence
ggaggttggggaagggcacg

SEQ ID NO: 4100 - DNA, 20 bp, Artificial
  20-mer unique DNA sequence
gatccaaccccaacccgcat

SEQ ID NO: 4101 - DNA, 20 bp, Artificial
  20-mer unique DNA sequence
gtccccatctcccgtgcctc

SEQ ID NO: 4102 - DNA, 20 bp, Artificial
  20-mer unique DNA sequence
cccgccgccatcatagaaac

SEQ ID NO: 4103 - DNA, 20 bp, Artificial
  20-mer unique DNA sequence
tgcgggggaggcttttctgt

SEQ ID NO: 4104 - DNA, 20 bp, Artificial
  20-mer unique DNA sequence
ttcttgcttgtgccctgccg

SEQ ID NO: 4105 - DNA, 20 bp, Artificial
  20-mer unique DNA sequence
agcggaggaactttgagcgg

SEQ ID NO: 4106 - DNA, 20 bp, Artificial
  20-mer unique DNA sequence
agcatcagtggttcgggggt

SEQ ID NO: 4107 - DNA, 20 bp, Artificial
  20-mer unique DNA sequence
atctcggaccctcgccccct

SEQ ID NO: 4108 - DNA, 20 bp, Artificial
  20-mer unique DNA sequence
actggggcgggcataaaaga

SEQ ID NO: 4109 - DNA, 20 bp, Artificial
  20-mer unique DNA sequence
tgttctctccaccctcgccg

SEQ ID NO: 4110 - DNA, 20 bp, Artificial
  20-mer unique DNA sequence
tgcctcgcttgctcctcttg

SEQ ID NO: 4111 - DNA, 20 bp, Artificial
  20-mer unique DNA sequence
atcctccatcacttcgcccg

SEQ ID NO: 4112 - DNA, 20 bp, Artificial
  20-mer unique DNA sequence
gtttcagggcatcggagagg

SEQ ID NO: 4113 - DNA, 20 bp, Artificial
  20-mer unique DNA sequence
cgcttgctttgcttgcccga

SEQ ID NO: 4114 - DNA, 20 bp, Artificial
  20-mer unique DNA sequence
gagtttcgttccggttgccc

SEQ ID NO: 4115 - DNA, 20 bp, Artificial
  20-mer unique DNA sequence
tcggtgagtggcgcaaagca

SEQ ID NO: 4116 - DNA, 20 bp, Artificial
  20-mer unique DNA sequence
ctgcggtgatggttgtgcgt

SEQ ID NO: 4117 - DNA, 20 bp, Artificial
  20-mer unique DNA sequence
agcagggggcgcaaaggtag

SEQ ID NO: 4118 - DNA, 20 bp, Artificial
  20-mer unique DNA sequence
ccatctgcagcccatccgtt

SEQ ID NO: 4119 - DNA, 20 bp, Artificial
  20-mer unique DNA sequence
gagctcccgcatttgaaccc

SEQ ID NO: 4120 - DNA, 20 bp, Artificial
  20-mer unique DNA sequence
tgatgggggcaagtgggtcg

SEQ ID NO: 4121 - DNA, 20 bp, Artificial
  20-mer unique DNA sequence
cgccaagcacaccgcacaga

SEQ ID NO: 4122 - DNA, 20 bp, Artificial
  20-mer unique DNA sequence
gcgctgggccttcggtacaa

SEQ ID NO: 4123 - DNA, 20 bp, Artificial
  20-mer unique DNA sequence
aacccccccctgcttgacgt

SEQ ID NO: 4124 - DNA, 20 bp, Artificial
  20-mer unique DNA sequence
acagtcgtccaacggggcgg

SEQ ID NO: 4125 - DNA, 20 bp, Artificial
  20-mer unique DNA sequence
ccaggcccagacccgaggaa

SEQ ID NO: 4126 - DNA, 20 bp, Artificial
  20-mer unique DNA sequence
actcgcactagcgaacgaca

SEQ ID NO: 4127 - DNA, 20 bp, Artificial
  20-mer unique DNA sequence
gcggacagggacacacacgg

SEQ ID NO: 4128 - DNA, 20 bp, Artificial
  20-mer unique DNA sequence
gatcccccgctgcaactccg

SEQ ID NO: 4129 - DNA, 20 bp, Artificial
  20-mer unique DNA sequence
tcgggaatacgcgggtgtgg

SEQ ID NO: 4130 - DNA, 20 bp, Artificial
  20-mer unique DNA sequence
ccagacccacagccacccag

SEQ ID NO: 4131 - DNA, 20 bp, Artificial
  20-mer unique DNA sequence
cgacccgcaacgaacaaggt

SEQ ID NO: 4132 - DNA, 20 bp, Artificial
  20-mer unique DNA sequence
cgcaccaagacggccaggat

SEQ ID NO: 4133 - DNA, 20 bp, Artificial
  20-mer unique DNA sequence
ggtgatgttggggcgaggct

SEQ ID NO: 4134 - DNA, 20 bp, Artificial
  20-mer unique DNA sequence
cactcgcacaccgccaactt

SEQ ID NO: 4135 - DNA, 20 bp, Artificial
  20-mer unique DNA sequence
gctgggtgtgcgtcttcctg

SEQ ID NO: 4136 - DNA, 20 bp, Artificial
  20-mer unique DNA sequence
ctacgggggaaatggggggc

SEQ ID NO: 4137 - DNA, 20 bp, Artificial
  20-mer unique DNA sequence
acagccacccaaccccgatc

SEQ ID NO: 4138 - DNA, 20 bp, Artificial
  20-mer unique DNA sequence
cgcaccacgatacaccccag

SEQ ID NO: 4139 - DNA, 20 bp, Artificial
  20-mer unique DNA sequence
cctattcacccccgctttcg

SEQ ID NO: 4140 - DNA, 20 bp, Artificial
  20-mer unique DNA sequence
acccaaagaccacgcggcaa

SEQ ID NO: 4141 - DNA, 20 bp, Artificial
  20-mer unique DNA sequence
agatccgcaggccaacgcac

SEQ ID NO: 4142 - DNA, 20 bp, Artificial
  20-mer unique DNA sequence
agctttctcccaatcgcccg

SEQ ID NO: 4143 - DNA, 20 bp, Artificial
  20-mer unique DNA sequence
ggctggccgaatgcttgatg

SEQ ID NO: 4144 - DNA, 20 bp, Artificial
  20-mer unique DNA sequence
ttcgtcatgctgggcggacg

SEQ ID NO: 4145 - DNA, 20 bp, Artificial
  20-mer unique DNA sequence
ccttgcaaagtacgcccggc

SEQ ID NO: 4146 - DNA, 20 bp, Artificial
  20-mer unique DNA sequence
ttaaggacgcaaaagccccg

SEQ ID NO: 4147 - DNA, 20 bp, Artificial
  20-mer unique DNA sequence
gcggaaacgactgctgaccc

SEQ ID NO: 4148 - DNA, 20 bp, Artificial
  20-mer unique DNA sequence
gggaggctgattggcggatg

SEQ ID NO: 4149 - DNA, 20 bp, Artificial
  20-mer unique DNA sequence
gtccaggggtgccagaaacg

SEQ ID NO: 4150 - DNA, 20 bp, Artificial
  20-mer unique DNA sequence
ggggtggcatgtcttgggat

SEQ ID NO: 4151 - DNA, 20 bp, Artificial
  20-mer unique DNA sequence
cgggagctgggctgtcatca

SEQ ID NO: 4152 - DNA, 20 bp, Artificial
  20-mer unique DNA sequence
tcctaagcaaggcgccccgt

SEQ ID NO: 4153 - DNA, 20 bp, Artificial
  20-mer unique DNA sequence
gacacgtcaggcgcacaccc

SEQ ID NO: 4154 - DNA, 20 bp, Artificial
  20-mer unique DNA sequence
cgagcgggcaatgggtaacg

SEQ ID NO: 4155 - DNA, 20 bp, Artificial
  20-mer unique DNA sequence
cccgaagcagcaccggatca

SEQ ID NO: 4156 - DNA, 20 bp, Artificial
  20-mer unique DNA sequence
tcgcgcatcggagtgttagg

SEQ ID NO: 4157 - DNA, 20 bp, Artificial
  20-mer unique DNA sequence
ccccctcggcagttgtttca

SEQ ID NO: 4158 - DNA, 20 bp, Artificial
  20-mer unique DNA sequence
tcctgacatgctggccctcg

SEQ ID NO: 4159 - DNA, 20 bp, Artificial
  20-mer unique DNA sequence
cgccggacgttgagggtatg

SEQ ID NO: 4160 - DNA, 20 bp, Artificial
  20-mer unique DNA sequence
aatctcaacccccaccagcg

SEQ ID NO: 4161 - DNA, 20 bp, Artificial
  20-mer unique DNA sequence
gatgttttcagcggcctccc

SEQ ID NO: 4162 - DNA, 20 bp, Artificial
  20-mer unique DNA sequence
atcgcgcgtctgagttgcag

SEQ ID NO: 4163 - DNA, 20 bp, Artificial
  20-mer unique DNA sequence
tgctctgagcgtcggctgaa

SEQ ID NO: 4164 - DNA, 20 bp, Artificial
  20-mer unique DNA sequence
gcctgcttcgtccccgtatg

SEQ ID NO: 4165 - DNA, 20 bp, Artificial
  20-mer unique DNA sequence
gaggtgggcaaggatggacg

SEQ ID NO: 4166 - DNA, 20 bp, Artificial
  20-mer unique DNA sequence
gtggcttggatggcgtggtt

SEQ ID NO: 4167 - DNA, 20 bp, Artificial
  20-mer unique DNA sequence
tggcgttttcggttcggtct

SEQ ID NO: 4168 - DNA, 20 bp, Artificial
  20-mer unique DNA sequence
ttctcatgtaaggcgccgcg

SEQ ID NO: 4169 - DNA, 20 bp, Artificial
  20-mer unique DNA sequence
aacatcggcccacccgctaa

SEQ ID NO: 4170 - DNA, 20 bp, Artificial
  20-mer unique DNA sequence
gatggcttaaggtggggctc

SEQ ID NO: 4171 - DNA, 20 bp, Artificial
  20-mer unique DNA sequence
tgtttcccccgcctcccaat

SEQ ID NO: 4172 - DNA, 20 bp, Artificial
  20-mer unique DNA sequence
gacgtacccgacccagccac

SEQ ID NO: 4173 - DNA, 20 bp, Artificial
  20-mer unique DNA sequence
tgagtgcttgtgcggtcgga

SEQ ID NO: 4174 - DNA, 20 bp, Artificial
  20-mer unique DNA sequence
aggaacggacgggggaagac

SEQ ID NO: 4175 - DNA, 20 bp, Artificial
  20-mer unique DNA sequence
gcgggaaagtgggacaggtg

SEQ ID NO: 4176 - DNA, 20 bp, Artificial
  20-mer unique DNA sequence
ggttcccctctcccaccctg

SEQ ID NO: 4177 - DNA, 20 bp, Artificial
  20-mer unique DNA sequence
cttcctgccccaagtcgcgt

SEQ ID NO: 4178 - DNA, 20 bp, Artificial
  20-mer unique DNA sequence
aacatatcccccccgccaac

SEQ ID NO: 4179 - DNA, 20 bp, Artificial
  20-mer unique DNA sequence
gccaaaccgctgcacccatt

SEQ ID NO: 4180 - DNA, 20 bp, Artificial
  20-mer unique DNA sequence
ttgcattcccgatgggccta

SEQ ID NO: 4181 - DNA, 20 bp, Artificial
  20-mer unique DNA sequence
cggcggccataagacagacc

SEQ ID NO: 4182 - DNA, 20 bp, Artificial
  20-mer unique DNA sequence
aacggctatcgagagggggc

SEQ ID NO: 4183 - DNA, 20 bp, Artificial
  20-mer unique DNA sequence
ccgccagtggaagatcgcca

SEQ ID NO: 4184 - DNA, 20 bp, Artificial
  20-mer unique DNA sequence
tgattgccgccctgtgtcct

SEQ ID NO: 4185 - DNA, 20 bp, Artificial
  20-mer unique DNA sequence
ccgccgtcctcgcccttcta

SEQ ID NO: 4186 - DNA, 20 bp, Artificial
  20-mer unique DNA sequence
tgctcgcctcaccctgtcaa

SEQ ID NO: 4187 - DNA, 20 bp, Artificial
  20-mer unique DNA sequence
ttcgataccccgctcacccg

SEQ ID NO: 4188 - DNA, 20 bp, Artificial
  20-mer unique DNA sequence
tggggcgtgaggcttgtggt

SEQ ID NO: 4189 - DNA, 20 bp, Artificial
  20-mer unique DNA sequence
gtgggcaggtttgcgatggg

SEQ ID NO: 4190 - DNA, 20 bp, Artificial
  20-mer unique DNA sequence
tggccaccgattcaccgctt

SEQ ID NO: 4191 - DNA, 20 bp, Artificial
  20-mer unique DNA sequence
tgaaaccaacctcgcgcgtc

SEQ ID NO: 4192 - DNA, 20 bp, Artificial
  20-mer unique DNA sequence
acccccacagctgcctacca

SEQ ID NO: 4193 - DNA, 20 bp, Artificial
  20-mer unique DNA sequence
ccccgggtcacacaaatgcg

SEQ ID NO: 4194 - DNA, 20 bp, Artificial
  20-mer unique DNA sequence
tgctaccgaatactgcgcgc

SEQ ID NO: 4195 - DNA, 20 bp, Artificial
  20-mer unique DNA sequence
acggttggctccctcccagg

SEQ ID NO: 4196 - DNA, 20 bp, Artificial
  20-mer unique DNA sequence
cctacccccggcgtttacaa

SEQ ID NO: 4197 - DNA, 20 bp, Artificial
  20-mer unique DNA sequence
cgattacgtagctgcgcccc

SEQ ID NO: 4198 - DNA, 20 bp, Artificial
  20-mer unique DNA sequence
aaaaccttcctccgcacccc

SEQ ID NO: 4199 - DNA, 20 bp, Artificial
  20-mer unique DNA sequence
cgcccacgcccatcatccac

SEQ ID NO: 4200 - DNA, 20 bp, Artificial
  20-mer unique DNA sequence
gtggtgaatggtgtggcgct

SEQ ID NO: 4201 - DNA, 20 bp, Artificial
  20-mer unique DNA sequence
gacagcggggcgaagaacaa

SEQ ID NO: 4202 - DNA, 20 bp, Artificial
  20-mer unique DNA sequence
aagaacgtggaacggccgga

SEQ ID NO: 4203 - DNA, 20 bp, Artificial
  20-mer unique DNA sequence
gggagggggtggagaagcaa

SEQ ID NO: 4204 - DNA, 20 bp, Artificial
  20-mer unique DNA sequence
ccaagacccacatcgccacg

SEQ ID NO: 4205 - DNA, 20 bp, Artificial
  20-mer unique DNA sequence
cgcgcggtctccttcctact

SEQ ID NO: 4206 - DNA, 20 bp, Artificial
  20-mer unique DNA sequence
ttcgggagtgcatcttgggg

SEQ ID NO: 4207 - DNA, 20 bp, Artificial
  20-mer unique DNA sequence
gagcccactgtccatcccga

SEQ ID NO: 4208 - DNA, 20 bp, Artificial
  20-mer unique DNA sequence
atcgcccacttcccgcatct

SEQ ID NO: 4209 - DNA, 20 bp, Artificial
  20-mer unique DNA sequence
tgtccctcccgccactgatt

SEQ ID NO: 4210 - DNA, 20 bp, Artificial
  20-mer unique DNA sequence
ggcgggcgacgataaacttg

SEQ ID NO: 4211 - DNA, 20 bp, Artificial
  20-mer unique DNA sequence
ctctgttaccccccgcccga

SEQ ID NO: 4212 - DNA, 20 bp, Artificial
  20-mer unique DNA sequence
aaccacccaccccgtcttga

SEQ ID NO: 4213 - DNA, 20 bp, Artificial
  20-mer unique DNA sequence
gcgttgctgctggcttttga

SEQ ID NO: 4214 - DNA, 20 bp, Artificial
  20-mer unique DNA sequence
gcgcctgccatccgtttcct

SEQ ID NO: 4215 - DNA, 20 bp, Artificial
  20-mer unique DNA sequence
gccattccccccatcgacct

SEQ ID NO: 4216 - DNA, 20 bp, Artificial
  20-mer unique DNA sequence
gcgactgggttgagcgattg

SEQ ID NO: 4217 - DNA, 20 bp, Artificial
  20-mer unique DNA sequence
ggagccgagggtgaaaaggc

SEQ ID NO: 4218 - DNA, 20 bp, Artificial
  20-mer unique DNA sequence
cctcgcaagggcggtcttaa

SEQ ID NO: 4219 - DNA, 20 bp, Artificial
  20-mer unique DNA sequence
tgctcaattacccatgggcg

SEQ ID NO: 4220 - DNA, 20 bp, Artificial
  20-mer unique DNA sequence
cgtgaatagtacgcgggcgc

SEQ ID NO: 4221 - DNA, 20 bp, Artificial
  20-mer unique DNA sequence
gattggggcgtgtcgtctaa

SEQ ID NO: 4222 - DNA, 20 bp, Artificial
  20-mer unique DNA sequence
cacatgagcctagaccggca

SEQ ID NO: 4223 - DNA, 20 bp, Artificial
  20-mer unique DNA sequence
ctcgaccccacgccttccgt

SEQ ID NO: 4224 - DNA, 20 bp, Artificial
  20-mer unique DNA sequence
cgtttatgcccgcgtgttcg

SEQ ID NO: 4225 - DNA, 20 bp, Artificial
  20-mer unique DNA sequence
cgtaagtcgcccaggtcccg

SEQ ID NO: 4226 - DNA, 20 bp, Artificial
  20-mer unique DNA sequence
cggtcttcttgcccgtctcc

SEQ ID NO: 4227 - DNA, 20 bp, Artificial
  20-mer unique DNA sequence
gcagcaaggaggcgagggtc

SEQ ID NO: 4228 - DNA, 20 bp, Artificial
  20-mer unique DNA sequence
caggcggagggatagaggcg

SEQ ID NO: 4229 - DNA, 20 bp, Artificial
  20-mer unique DNA sequence
gacacacagcatcacgcgca

SEQ ID NO: 4230 - DNA, 20 bp, Artificial
  20-mer unique DNA sequence
tatgaaagccacgcccggaa

SEQ ID NO: 4231 - DNA, 20 bp, Artificial
  20-mer unique DNA sequence
cccaatcttcgcacccgttc

SEQ ID NO: 4232 - DNA, 20 bp, Artificial
  20-mer unique DNA sequence
aaccccgctctttcgctcaa

SEQ ID NO: 4233 - DNA, 20 bp, Artificial
  20-mer unique DNA sequence
tttccctccggcttctgata

SEQ ID NO: 4234 - DNA, 20 bp, Artificial
  20-mer unique DNA sequence
tagcagcgcttccgtcggtt

SEQ ID NO: 4235 - DNA, 20 bp, Artificial
  20-mer unique DNA sequence
aaaataaacctcgccggcca

SEQ ID NO: 4236 - DNA, 20 bp, Artificial
  20-mer unique DNA sequence
cgcaaccgagcagcaaaatg

SEQ ID NO: 4237 - DNA, 20 bp, Artificial
  20-mer unique DNA sequence
tgaggggaatgccaagggag

SEQ ID NO: 4238 - DNA, 20 bp, Artificial
  20-mer unique DNA sequence
cccctacgtgtgatcccggt

SEQ ID NO: 4239 - DNA, 20 bp, Artificial
  20-mer unique DNA sequence
gatagagagcgcgcgttgcg

SEQ ID NO: 4240 - DNA, 20 bp, Artificial
  20-mer unique DNA sequence
atgggggagacatgtttgcg

SEQ ID NO: 4241 - DNA, 20 bp, Artificial
  20-mer unique DNA sequence
aatatcctgcggcccatcca

SEQ ID NO: 4242 - DNA, 20 bp, Artificial
  20-mer unique DNA sequence
ccacggcggccctaaactga

SEQ ID NO: 4243 - DNA, 20 bp, Artificial
  20-mer unique DNA sequence
ttttcgcgccctgatgtgga

SEQ ID NO: 4244 - DNA, 20 bp, Artificial
  20-mer unique DNA sequence
gcggcaaggcgaggtagtga

SEQ ID NO: 4245 - DNA, 20 bp, Artificial
  20-mer unique DNA sequence
gaaagggccggacgatggat

SEQ ID NO: 4246 - DNA, 20 bp, Artificial
  20-mer unique DNA sequence
gtaaatttcggcggggagcg

SEQ ID NO: 4247 - DNA, 20 bp, Artificial
  20-mer unique DNA sequence
ttgggtcgttgggagggtga

SEQ ID NO: 4248 - DNA, 20 bp, Artificial
  20-mer unique DNA sequence
gtgcgtgattcagtcgcggt

SEQ ID NO: 4249 - DNA, 20 bp, Artificial
  20-mer unique DNA sequence
gctgtcgacgaacgtcactg

SEQ ID NO: 4250 - DNA, 20 bp, Artificial
  20-mer unique DNA sequence
gtttgcattttggcgcgcgt

SEQ ID NO: 4251 - DNA, 20 bp, Artificial
  20-mer unique DNA sequence
agaagggcagggatgcgagg

SEQ ID NO: 4252 - DNA, 20 bp, Artificial
  20-mer unique DNA sequence
gcggcagccatgttcgtaga

SEQ ID NO: 4253 - DNA, 20 bp, Artificial
  20-mer unique DNA sequence
caatagtgaacgcccgccaa

SEQ ID NO: 4254 - DNA, 20 bp, Artificial
  20-mer unique DNA sequence
tttccgacacagcagccagg

SEQ ID NO: 4255 - DNA, 20 bp, Artificial
  20-mer unique DNA sequence
gcacgacccccgtatggaga

SEQ ID NO: 4256 - DNA, 20 bp, Artificial
  20-mer unique DNA sequence
ccttcttgccgccccgtttt

SEQ ID NO: 4257 - DNA, 20 bp, Artificial
  20-mer unique DNA sequence
atcgaagccactccccgcag

SEQ ID NO: 4258 - DNA, 20 bp, Artificial
  20-mer unique DNA sequence
gactggacgcaaacgacgga

SEQ ID NO: 4259 - DNA, 20 bp, Artificial
  20-mer unique DNA sequence
ggagataggccggatgagcg

SEQ ID NO: 4260 - DNA, 20 bp, Artificial
  20-mer unique DNA sequence
tccatacccgtcccccgctt

SEQ ID NO: 4261 - DNA, 20 bp, Artificial
  20-mer unique DNA sequence
ggctgtatggagggcgtgga

SEQ ID NO: 4262 - DNA, 20 bp, Artificial
  20-mer unique DNA sequence
agtcccgcgtcccttaagca

SEQ ID NO: 4263 - DNA, 20 bp, Artificial
  20-mer unique DNA sequence
gcggaggggggggaagttag

SEQ ID NO: 4264 - DNA, 20 bp, Artificial
  20-mer unique DNA sequence
gggcgagcgttacacgggta

SEQ ID NO: 4265 - DNA, 20 bp, Artificial
  20-mer unique DNA sequence
tgaaccccgtccgaccgata

SEQ ID NO: 4266 - DNA, 20 bp, Artificial
  20-mer unique DNA sequence
gcagggaatcgggaacgcca

SEQ ID NO: 4267 - DNA, 20 bp, Artificial
  20-mer unique DNA sequence
tttgttgcggctttgcgatt

SEQ ID NO: 4268 - DNA, 20 bp, Artificial
  20-mer unique DNA sequence
cattagttggcgcaggggct

SEQ ID NO: 4269 - DNA, 20 bp, Artificial
  20-mer unique DNA sequence
cgtgttggaggggctaggag

SEQ ID NO: 4270 - DNA, 20 bp, Artificial
  20-mer unique DNA sequence
gctacgggcgggataaccca

SEQ ID NO: 4271 - DNA, 20 bp, Artificial
  20-mer unique DNA sequence
tgcgtgtgtcccgatgtggt

SEQ ID NO: 4272 - DNA, 20 bp, Artificial
  20-mer unique DNA sequence
gcgggtgggacggactttta

SEQ ID NO: 4273 - DNA, 20 bp, Artificial
  20-mer unique DNA sequence
atgtctcccagcgtccccac

SEQ ID NO: 4274 - DNA, 20 bp, Artificial
  20-mer unique DNA sequence
agcgccggtggtaaaggaca

SEQ ID NO: 4275 - DNA, 20 bp, Artificial
  20-mer unique DNA sequence
cccaaccgcatcctttacgc

SEQ ID NO: 4276 - DNA, 20 bp, Artificial
  20-mer unique DNA sequence
acgctcccgccgacaaaatg

SEQ ID NO: 4277 - DNA, 20 bp, Artificial
  20-mer unique DNA sequence
ccaggtgcgtaacaccctgt

SEQ ID NO: 4278 - DNA, 20 bp, Artificial
  20-mer unique DNA sequence
gaggatgggggggagcgagt

SEQ ID NO: 4279 - DNA, 20 bp, Artificial
  20-mer unique DNA sequence
ggagcaggagaacgggggtc

SEQ ID NO: 4280 - DNA, 20 bp, Artificial
  20-mer unique DNA sequence
aatcaagcagaagcgggcgt

SEQ ID NO: 4281 - DNA, 20 bp, Artificial
  20-mer unique DNA sequence
cgtggttgtttcccgccgat

SEQ ID NO: 4282 - DNA, 20 bp, Artificial
  20-mer unique DNA sequence
gtgccgccctcctacgattc

SEQ ID NO: 4283 - DNA, 20 bp, Artificial
  20-mer unique DNA sequence
cggaaggggaaagagcaggc

SEQ ID NO: 4284 - DNA, 20 bp, Artificial
  20-mer unique DNA sequence
actcgccacaccgcctaacg

SEQ ID NO: 4285 - DNA, 20 bp, Artificial
  20-mer unique DNA sequence
tccccagattaccgcacgcc

SEQ ID NO: 4286 - DNA, 20 bp, Artificial
  20-mer unique DNA sequence
cagcacaccactgcccctga

SEQ ID NO: 4287 - DNA, 20 bp, Artificial
  20-mer unique DNA sequence
gaggaaccgaagaggcgggt

SEQ ID NO: 4288 - DNA, 20 bp, Artificial
  20-mer unique DNA sequence
tcttggacggcggaactgtg

SEQ ID NO: 4289 - DNA, 20 bp, Artificial
  20-mer unique DNA sequence
accgtttctgagggcccgac

SEQ ID NO: 4290 - DNA, 20 bp, Artificial
  20-mer unique DNA sequence
aggcaaccgcaggcataacc

SEQ ID NO: 4291 - DNA, 20 bp, Artificial
  20-mer unique DNA sequence
tttctgatccaaccacgcgg

SEQ ID NO: 4292 - DNA, 20 bp, Artificial
  20-mer unique DNA sequence
ccgcctcgtagacgccaaga

SEQ ID NO: 4293 - DNA, 20 bp, Artificial
  20-mer unique DNA sequence
cggcactcggaaacggctaa

SEQ ID NO: 4294 - DNA, 20 bp, Artificial
  20-mer unique DNA sequence
attgacggctggttcccccc

SEQ ID NO: 4295 - DNA, 20 bp, Artificial
  20-mer unique DNA sequence
ctgcactagtccccgcgtgg

SEQ ID NO: 4296 - DNA, 20 bp, Artificial
  20-mer unique DNA sequence
tttttgcgcacgggattggg

SEQ ID NO: 4297 - DNA, 20 bp, Artificial
  20-mer unique DNA sequence
gtcctgaaagcccgtgccgt

SEQ ID NO: 4298 - DNA, 20 bp, Artificial
  20-mer unique DNA sequence
cccctggataaccccttgcg

SEQ ID NO: 4299 - DNA, 20 bp, Artificial
  20-mer unique DNA sequence
cgcctgccgttgggaatatt

SEQ ID NO: 4300 - DNA, 20 bp, Artificial
  20-mer unique DNA sequence
tcgcgtgagtggtttgcgtg

SEQ ID NO: 4301 - DNA, 20 bp, Artificial
  20-mer unique DNA sequence
caaccgccccgacaaggata

SEQ ID NO: 4302 - DNA, 20 bp, Artificial
  20-mer unique DNA sequence
gagaacggggcactggctga

SEQ ID NO: 4303 - DNA, 20 bp, Artificial
  20-mer unique DNA sequence
tgctgcccacgttgttttgc

SEQ ID NO: 4304 - DNA, 20 bp, Artificial
  20-mer unique DNA sequence
tctgctagcgcgcgaagctt

SEQ ID NO: 4305 - DNA, 20 bp, Artificial
  20-mer unique DNA sequence
acgttgctggaccccttccg

SEQ ID NO: 4306 - DNA, 20 bp, Artificial
  20-mer unique DNA sequence
tgcgcgcccaagaagaaatg

SEQ ID NO: 4307 - DNA, 20 bp, Artificial
  20-mer unique DNA sequence
cgccgggatgggttagctct

SEQ ID NO: 4308 - DNA, 20 bp, Artificial
  20-mer unique DNA sequence
cggcgacgagattcgaagct

SEQ ID NO: 4309 - DNA, 20 bp, Artificial
  20-mer unique DNA sequence
tcccttttgagcccgacttg

SEQ ID NO: 4310 - DNA, 20 bp, Artificial
  20-mer unique DNA sequence
ttggggcggggtttggcagc

SEQ ID NO: 4311 - DNA, 20 bp, Artificial
  20-mer unique DNA sequence
gccgtgtatgctggggatgc

SEQ ID NO: 4312 - DNA, 20 bp, Artificial
  20-mer unique DNA sequence
gggaatgggacacgtgcgaa

SEQ ID NO: 4313 - DNA, 20 bp, Artificial
  20-mer unique DNA sequence
atgtctccccgtccgctgtc

SEQ ID NO: 4314 - DNA, 20 bp, Artificial
  20-mer unique DNA sequence
actcgcctcgacaaaacgcg

SEQ ID NO: 4315 - DNA, 20 bp, Artificial
  20-mer unique DNA sequence
gagctcgagcggggaagttg

SEQ ID NO: 4316 - DNA, 20 bp, Artificial
  20-mer unique DNA sequence
acgggaagcggacaaggatg

SEQ ID NO: 4317 - DNA, 20 bp, Artificial
  20-mer unique DNA sequence
tgtcctgttctcgcgtgggg

SEQ ID NO: 4318 - DNA, 20 bp, Artificial
  20-mer unique DNA sequence
ccccctccgctcgaattcat

SEQ ID NO: 4319 - DNA, 20 bp, Artificial
  20-mer unique DNA sequence
ccgtgcttgcgtccatgttt

SEQ ID NO: 4320 - DNA, 20 bp, Artificial
  20-mer unique DNA sequence
tgtcgtcaccctgtgtcccg

SEQ ID NO: 4321 - DNA, 20 bp, Artificial
  20-mer unique DNA sequence
tgcccccacaccccctctac

SEQ ID NO: 4322 - DNA, 20 bp, Artificial
  20-mer unique DNA sequence
cagcctccaaatgccccagt

SEQ ID NO: 4323 - DNA, 20 bp, Artificial
  20-mer unique DNA sequence
gggtgtgggcttgggcactg

SEQ ID NO: 4324 - DNA, 20 bp, Artificial
  20-mer unique DNA sequence
agctcattttgccgtcgcct

SEQ ID NO: 4325 - DNA, 20 bp, Artificial
  20-mer unique DNA sequence
gacaagcatggggggacgat

SEQ ID NO: 4326 - DNA, 20 bp, Artificial
  20-mer unique DNA sequence
ctctggcccccatgcttcgt

SEQ ID NO: 4327 - DNA, 20 bp, Artificial
  20-mer unique DNA sequence
gaagctccgacgacccccag

SEQ ID NO: 4328 - DNA, 20 bp, Artificial
  20-mer unique DNA sequence
tatctgcgcctgtccgaagc

SEQ ID NO: 4329 - DNA, 20 bp, Artificial
  20-mer unique DNA sequence
acggcgacgtccagaattga

SEQ ID NO: 4330 - DNA, 20 bp, Artificial
  20-mer unique DNA sequence
ggagccccgttgccagtttg

SEQ ID NO: 4331 - DNA, 20 bp, Artificial
  20-mer unique DNA sequence
agggcctaaagtcgcggagc

SEQ ID NO: 4332 - DNA, 20 bp, Artificial
  20-mer unique DNA sequence
gtggctcgtccgggtcttgt

SEQ ID NO: 4333 - DNA, 20 bp, Artificial
  20-mer unique DNA sequence
ggtgagagccggggtaagca

SEQ ID NO: 4334 - DNA, 20 bp, Artificial
  20-mer unique DNA sequence
atttgggccggaaggtacgc

SEQ ID NO: 4335 - DNA, 20 bp, Artificial
  20-mer unique DNA sequence
ccgttttgccggcgtttagg

SEQ ID NO: 4336 - DNA, 20 bp, Artificial
  20-mer unique DNA sequence
agcggtcgtgggtgtatgcg

SEQ ID NO: 4337 - DNA, 20 bp, Artificial
  20-mer unique DNA sequence
tgccgcctcccaactacagc

SEQ ID NO: 4338 - DNA, 20 bp, Artificial
  20-mer unique DNA sequence
gcgtggatggcggattgagg

SEQ ID NO: 4339 - DNA, 20 bp, Artificial
  20-mer unique DNA sequence
accgcccaaaaggtcccctg

SEQ ID NO: 4340 - DNA, 20 bp, Artificial
  20-mer unique DNA sequence
ccctctccgcccacctgtag

SEQ ID NO: 4341 - DNA, 20 bp, Artificial
  20-mer unique DNA sequence
gagtggaggggctggggtgt

SEQ ID NO: 4342 - DNA, 20 bp, Artificial
  20-mer unique DNA sequence
cccccttgctcggttgttgc

SEQ ID NO: 4343 - DNA, 20 bp, Artificial
  20-mer unique DNA sequence
tgtcaactcgtgggccgctg

SEQ ID NO: 4344 - DNA, 20 bp, Artificial
  20-mer unique DNA sequence
aggcacccgaagaagaccct

SEQ ID NO: 4345 - DNA, 20 bp, Artificial
  20-mer unique DNA sequence
gaactctccgcccacacgct

SEQ ID NO: 4346 - DNA, 20 bp, Artificial
  20-mer unique DNA sequence
gggagggcgttcagggagat

SEQ ID NO: 4347 - DNA, 20 bp, Artificial
  20-mer unique DNA sequence
ccccaaacccccttacgacc

SEQ ID NO: 4348 - DNA, 20 bp, Artificial
  20-mer unique DNA sequence
gcaggggcgggcaacagaaa

SEQ ID NO: 4349 - DNA, 20 bp, Artificial
  20-mer unique DNA sequence
atgggggggacaataagggc

SEQ ID NO: 4350 - DNA, 20 bp, Artificial
  20-mer unique DNA sequence
ccggacctcaccccatttgc

SEQ ID NO: 4351 - DNA, 20 bp, Artificial
  20-mer unique DNA sequence
gaagtgctgaaccgcgtccg

SEQ ID NO: 4352 - DNA, 20 bp, Artificial
  20-mer unique DNA sequence
aaaatggcactgggcgagcg

SEQ ID NO: 4353 - DNA, 20 bp, Artificial
  20-mer unique DNA sequence
gccccgtagctcacattgcg

SEQ ID NO: 4354 - DNA, 20 bp, Artificial
  20-mer unique DNA sequence
tccaagccaccgagccaacc

SEQ ID NO: 4355 - DNA, 20 bp, Artificial
  20-mer unique DNA sequence
gccgtgggactcttcgttgg

SEQ ID NO: 4356 - DNA, 20 bp, Artificial
  20-mer unique DNA sequence
tctcttcaggtacggcgcgc

SEQ ID NO: 4357 - DNA, 20 bp, Artificial
  20-mer unique DNA sequence
atcaccgtcgccctccagcc

SEQ ID NO: 4358 - DNA, 20 bp, Artificial
  20-mer unique DNA sequence
ggcgcgtgtagcagtgatcg

SEQ ID NO: 4359 - DNA, 20 bp, Artificial
  20-mer unique DNA sequence
ctgggggtgctcggttcgaa

SEQ ID NO: 4360 - DNA, 20 bp, Artificial
  20-mer unique DNA sequence
agccaggcgcggtcctataa

SEQ ID NO: 4361 - DNA, 20 bp, Artificial
  20-mer unique DNA sequence
aatgcccgggccacatcgtt

SEQ ID NO: 4362 - DNA, 20 bp, Artificial
  20-mer unique DNA sequence
ttaaaacgtcccccacgccg

SEQ ID NO: 4363 - DNA, 20 bp, Artificial
  20-mer unique DNA sequence
gcccaggaagggggtgtgtc

SEQ ID NO: 4364 - DNA, 20 bp, Artificial
  20-mer unique DNA sequence
cacgcaccccccaacttcat

SEQ ID NO: 4365 - DNA, 20 bp, Artificial
  20-mer unique DNA sequence
cgtggggggttccttctctg

SEQ ID NO: 4366 - DNA, 20 bp, Artificial
  20-mer unique DNA sequence
ggtttgcgccttcccttttg

SEQ ID NO: 4367 - DNA, 20 bp, Artificial
  20-mer unique DNA sequence
gtcacccccttacatgcgcg

SEQ ID NO: 4368 - DNA, 20 bp, Artificial
  20-mer unique DNA sequence
aagcttccccggctggtgtc

SEQ ID NO: 4369 - DNA, 20 bp, Artificial
  20-mer unique DNA sequence
ggcccaccgactcgacgact

SEQ ID NO: 4370 - DNA, 20 bp, Artificial
  20-mer unique DNA sequence
ccgggtgcgtcagaggggat

SEQ ID NO: 4371 - DNA, 20 bp, Artificial
  20-mer unique DNA sequence
tggcatctttacgacggcga

SEQ ID NO: 4372 - DNA, 20 bp, Artificial
  20-mer unique DNA sequence
gggtgtcggggcgtgtaaaa

SEQ ID NO: 4373 - DNA, 20 bp, Artificial
  20-mer unique DNA sequence
gttcattacgtgccgcgggg

SEQ ID NO: 4374 - DNA, 20 bp, Artificial
  20-mer unique DNA sequence
ttaaacccaagcgccaagca

SEQ ID NO: 4375 - DNA, 20 bp, Artificial
  20-mer unique DNA sequence
cgggcgggacaagcaaattc

SEQ ID NO: 4376 - DNA, 20 bp, Artificial
  20-mer unique DNA sequence
cttcaatgggcacgggcact

SEQ ID NO: 4377 - DNA, 20 bp, Artificial
  20-mer unique DNA sequence
cgatcacaccgcgccaatat

SEQ ID NO: 4378 - DNA, 20 bp, Artificial
  20-mer unique DNA sequence
ctcgtcttaggcccgttccg

SEQ ID NO: 4379 - DNA, 20 bp, Artificial
  20-mer unique DNA sequence
cccacaagacggcctgcaaa

SEQ ID NO: 4380 - DNA, 20 bp, Artificial
  20-mer unique DNA sequence
actggctcctttgctgcggg

SEQ ID NO: 4381 - DNA, 20 bp, Artificial
  20-mer unique DNA sequence
tctcgcgcccctatgcccta

SEQ ID NO: 4382 - DNA, 20 bp, Artificial
  20-mer unique DNA sequence
accgacctcatgctccacgc

SEQ ID NO: 4383 - DNA, 20 bp, Artificial
  20-mer unique DNA sequence
ggcacccaatgacagagccc

SEQ ID NO: 4384 - DNA, 20 bp, Artificial
  20-mer unique DNA sequence
atccgatgcggcctcacctg

SEQ ID NO: 4385 - DNA, 20 bp, Artificial
  20-mer unique DNA sequence
gatgaagagtgcggcgcgtg

SEQ ID NO: 4386 - DNA, 20 bp, Artificial
  20-mer unique DNA sequence
accgcttcgaaaaccccttg

SEQ ID NO: 4387 - DNA, 20 bp, Artificial
  20-mer unique DNA sequence
gcgccggcctcagagtttcg

SEQ ID NO: 4388 - DNA, 20 bp, Artificial
  20-mer unique DNA sequence
ggcaccgcctcgtgttattc

SEQ ID NO: 4389 - DNA, 20 bp, Artificial
  20-mer unique DNA sequence
cgacaatacgaagcggcggg

SEQ ID NO: 4390 - DNA, 20 bp, Artificial
  20-mer unique DNA sequence
agcatagcccaagcgcgagg

SEQ ID NO: 4391 - DNA, 20 bp, Artificial
  20-mer unique DNA sequence
ccatgttctttcgccccggt

SEQ ID NO: 4392 - DNA, 20 bp, Artificial
  20-mer unique DNA sequence
cgcgtgtgcgtatgggttgc

SEQ ID NO: 4393 - DNA, 20 bp, Artificial
  20-mer unique DNA sequence
gacgctttgcggaggacatg

SEQ ID NO: 4394 - DNA, 20 bp, Artificial
  20-mer unique DNA sequence
ggtcgggccacggttatgac

SEQ ID NO: 4395 - DNA, 20 bp, Artificial
  20-mer unique DNA sequence
cgtacgcatcgcggaggaag

SEQ ID NO: 4396 - DNA, 20 bp, Artificial
  20-mer unique DNA sequence
catccgacccgcaagcaaaa

SEQ ID NO: 4397 - DNA, 20 bp, Artificial
  20-mer unique DNA sequence
tgggggcgagaagcaggtat

SEQ ID NO: 4398 - DNA, 20 bp, Artificial
  20-mer unique DNA sequence
cctttcatgcccgcgtctgc

SEQ ID NO: 4399 - DNA, 20 bp, Artificial
  20-mer unique DNA sequence
tgacgcccgtgacgacactc

SEQ ID NO: 4400 - DNA, 20 bp, Artificial
  20-mer unique DNA sequence
cgtctgcccatcgttcccaa

SEQ ID NO: 4401 - DNA, 20 bp, Artificial
  20-mer unique DNA sequence
cactacccgcccgttcaagc

SEQ ID NO: 4402 - DNA, 20 bp, Artificial
  20-mer unique DNA sequence
gtacacacactggccccccc

SEQ ID NO: 4403 - DNA, 20 bp, Artificial
  20-mer unique DNA sequence
gcgcaggccatctaacccag

SEQ ID NO: 4404 - DNA, 20 bp, Artificial
  20-mer unique DNA sequence
atggggtgcagggtaagccg

SEQ ID NO: 4405 - DNA, 20 bp, Artificial
  20-mer unique DNA sequence
gcaccccctcatgacaccct

SEQ ID NO: 4406 - DNA, 20 bp, Artificial
  20-mer unique DNA sequence
ggccttgtttgcgggtcgtc

SEQ ID NO: 4407 - DNA, 20 bp, Artificial
  20-mer unique DNA sequence
gcctgggtcttcggggatcg

SEQ ID NO: 4408 - DNA, 20 bp, Artificial
  20-mer unique DNA sequence
aagatccagcccggcaaaac

SEQ ID NO: 4409 - DNA, 20 bp, Artificial
  20-mer unique DNA sequence
cttgcaaaacgccagccgct

SEQ ID NO: 4410 - DNA, 20 bp, Artificial
  20-mer unique DNA sequence
tagttcggctggggtgcaga

SEQ ID NO: 4411 - DNA, 20 bp, Artificial
  20-mer unique DNA sequence
attagcgggtgcgtgtgggt

SEQ ID NO: 4412 - DNA, 20 bp, Artificial
  20-mer unique DNA sequence
cctgcccccttggagcctgt

SEQ ID NO: 4413 - DNA, 20 bp, Artificial
  20-mer unique DNA sequence
gacccccctgtctgcgaacc

SEQ ID NO: 4414 - DNA, 20 bp, Artificial
  20-mer unique DNA sequence
acagatccaccgaggccgcc

SEQ ID NO: 4415 - DNA, 20 bp, Artificial
  20-mer unique DNA sequence
ccgttggaagcccgattgat

SEQ ID NO: 4416 - DNA, 20 bp, Artificial
  20-mer unique DNA sequence
gcatctgcaggctaagccac

SEQ ID NO: 4417 - DNA, 20 bp, Artificial
  20-mer unique DNA sequence
aatcagagcgctcgcaaacc

SEQ ID NO: 4418 - DNA, 20 bp, Artificial
  20-mer unique DNA sequence
ccgttacgtcggctgtacaa

SEQ ID NO: 4419 - DNA, 20 bp, Artificial
  20-mer unique DNA sequence
gggaccccaacctgctacaa

SEQ ID NO: 4420 - DNA, 20 bp, Artificial
  20-mer unique DNA sequence
cggcctagtgcgatgagcta

SEQ ID NO: 4421 - DNA, 20 bp, Artificial
  20-mer unique DNA sequence
gccgcagtcacgtggatgtt

SEQ ID NO: 4422 - DNA, 20 bp, Artificial
  20-mer unique DNA sequence
ggggggggagaggaaagctt

SEQ ID NO: 4423 - DNA, 20 bp, Artificial
  20-mer unique DNA sequence
gcgtatctccggcagcttga

SEQ ID NO: 4424 - DNA, 20 bp, Artificial
  20-mer unique DNA sequence
ctagcgctcccactcccgac

SEQ ID NO: 4425 - DNA, 20 bp, Artificial
  20-mer unique DNA sequence
cagagagagagcgcgtgggc

SEQ ID NO: 4426 - DNA, 20 bp, Artificial
  20-mer unique DNA sequence
atcccccgaaacactccctg

SEQ ID NO: 4427 - DNA, 20 bp, Artificial
  20-mer unique DNA sequence
tgtctgtggcttggcggtga

SEQ ID NO: 4428 - DNA, 20 bp, Artificial
  20-mer unique DNA sequence
ttgttcgtgattgcgccccc

SEQ ID NO: 4429 - DNA, 20 bp, Artificial
  20-mer unique DNA sequence
taactacgtgcgagcgcctc

SEQ ID NO: 4430 - DNA, 20 bp, Artificial
  20-mer unique DNA sequence
agggcggagggaaatcggat

SEQ ID NO: 4431 - DNA, 20 bp, Artificial
  20-mer unique DNA sequence
gaaccggagagaaacggggg

SEQ ID NO: 4432 - DNA, 20 bp, Artificial
  20-mer unique DNA sequence
cactgattggggctgagggg

SEQ ID NO: 4433 - DNA, 20 bp, Artificial
  20-mer unique DNA sequence
ccccttgccttagccccttg

SEQ ID NO: 4434 - DNA, 20 bp, Artificial
  20-mer unique DNA sequence
aggtcgtgggattgggtggt

SEQ ID NO: 4435 - DNA, 20 bp, Artificial
  20-mer unique DNA sequence
tatcccaacgggcccgagta

SEQ ID NO: 4436 - DNA, 20 bp, Artificial
  20-mer unique DNA sequence
ctcgccaatgtacgctccgg

SEQ ID NO: 4437 - DNA, 20 bp, Artificial
  20-mer unique DNA sequence
aacgaccgaaccgcaacaca

SEQ ID NO: 4438 - DNA, 20 bp, Artificial
  20-mer unique DNA sequence
cctttttgcctcagtcccgc

SEQ ID NO: 4439 - DNA, 20 bp, Artificial
  20-mer unique DNA sequence
ttggttggggtttccgctgc

SEQ ID NO: 4440 - DNA, 20 bp, Artificial
  20-mer unique DNA sequence
cccacgcggggtaaacagat

SEQ ID NO: 4441 - DNA, 20 bp, Artificial
  20-mer unique DNA sequence
ttgagaatgtcccgcgctgt

SEQ ID NO: 4442 - DNA, 20 bp, Artificial
  20-mer unique DNA sequence
atcgcccctgcaccgtttga

SEQ ID NO: 4443 - DNA, 20 bp, Artificial
  20-mer unique DNA sequence
aaccaattagcgcgcgacga

SEQ ID NO: 4444 - DNA, 20 bp, Artificial
  20-mer unique DNA sequence
tttaagccccaccgccagac

SEQ ID NO: 4445 - DNA, 20 bp, Artificial
  20-mer unique DNA sequence
gtagttcgatccccgcccca

SEQ ID NO: 4446 - DNA, 20 bp, Artificial
  20-mer unique DNA sequence
gggaggaatggggcgacgat

SEQ ID NO: 4447 - DNA, 20 bp, Artificial
  20-mer unique DNA sequence
attgcgccaaacgagcagtg

SEQ ID NO: 4448 - DNA, 20 bp, Artificial
  20-mer unique DNA sequence
gtcgatacgggcgtcgatga

SEQ ID NO: 4449 - DNA, 20 bp, Artificial
  20-mer unique DNA sequence
gcggctgggtcctgatacaa

SEQ ID NO: 4450 - DNA, 20 bp, Artificial
  20-mer unique DNA sequence
gcgggctaatccaaggacga

SEQ ID NO: 4451 - DNA, 20 bp, Artificial
  20-mer unique DNA sequence
gccagcccgcacgaatctaa

SEQ ID NO: 4452 - DNA, 20 bp, Artificial
  20-mer unique DNA sequence
agggggctcaagggctcagg

SEQ ID NO: 4453 - DNA, 20 bp, Artificial
  20-mer unique DNA sequence
ggtcggtgatggctttgcga

SEQ ID NO: 4454 - DNA, 20 bp, Artificial
  20-mer unique DNA sequence
aagaaggatgggttgcgggc

SEQ ID NO: 4455 - DNA, 20 bp, Artificial
  20-mer unique DNA sequence
gagcgggagggtggatgatg

SEQ ID NO: 4456 - DNA, 20 bp, Artificial
  20-mer unique DNA sequence
caaagtccacggtccccagg

SEQ ID NO: 4457 - DNA, 20 bp, Artificial
  20-mer unique DNA sequence
gcacgggcgagttctttggc

SEQ ID NO: 4458 - DNA, 20 bp, Artificial
  20-mer unique DNA sequence
attcccttgccccactgacc

SEQ ID NO: 4459 - DNA, 20 bp, Artificial
  20-mer unique DNA sequence
atcgcctccctccccccagt

SEQ ID NO: 4460 - DNA, 20 bp, Artificial
  20-mer unique DNA sequence
tcatggggcgtccgatttct

SEQ ID NO: 4461 - DNA, 20 bp, Artificial
  20-mer unique DNA sequence
gaaccccgccgcgaatttca

SEQ ID NO: 4462 - DNA, 20 bp, Artificial
  20-mer unique DNA sequence
ctgcccgagaccattcaccc

SEQ ID NO: 4463 - DNA, 20 bp, Artificial
  20-mer unique DNA sequence
ctggcggtctggagggtctg

SEQ ID NO: 4464 - DNA, 20 bp, Artificial
  20-mer unique DNA sequence
cacttccttgcgtgcctccg

SEQ ID NO: 4465 - DNA, 20 bp, Artificial
  20-mer unique DNA sequence
aggctgatttggcccgattg

SEQ ID NO: 4466 - DNA, 20 bp, Artificial
  20-mer unique DNA sequence
aatcggtggaatcagggggg

SEQ ID NO: 4467 - DNA, 20 bp, Artificial
  20-mer unique DNA sequence
gcattcatggccaacccctc

SEQ ID NO: 4468 - DNA, 20 bp, Artificial
  20-mer unique DNA sequence
gctgccccggttactgaccc

SEQ ID NO: 4469 - DNA, 20 bp, Artificial
  20-mer unique DNA sequence
gttttgcggtcaggccatgg

SEQ ID NO: 4470 - DNA, 20 bp, Artificial
  20-mer unique DNA sequence
cacaatccaatagggccggc

SEQ ID NO: 4471 - DNA, 20 bp, Artificial
  20-mer unique DNA sequence
tcacaaccaagatgccccgc

SEQ ID NO: 4472 - DNA, 20 bp, Artificial
  20-mer unique DNA sequence
ctgagaccgcgcaacacgga

SEQ ID NO: 4473 - DNA, 20 bp, Artificial
  20-mer unique DNA sequence
tgcgccgtagcagaatgagc

SEQ ID NO: 4474 - DNA, 20 bp, Artificial
  20-mer unique DNA sequence
cgcacgagagacccccactg

SEQ ID NO: 4475 - DNA, 20 bp, Artificial
  20-mer unique DNA sequence
tggtctccgctcgttttggg

SEQ ID NO: 4476 - DNA, 20 bp, Artificial
  20-mer unique DNA sequence
tgcaagctaaagggggcggc

SEQ ID NO: 4477 - DNA, 20 bp, Artificial
  20-mer unique DNA sequence
cggcaggtgaggacaatagg

SEQ ID NO: 4478 - DNA, 20 bp, Artificial
  20-mer unique DNA sequence
ggcgcggtccattgcaactt

SEQ ID NO: 4479 - DNA, 20 bp, Artificial
  20-mer unique DNA sequence
gagctgtggggcatgtggca

SEQ ID NO: 4480 - DNA, 20 bp, Artificial
  20-mer unique DNA sequence
cgcagggacattgggcttca

SEQ ID NO: 4481 - DNA, 20 bp, Artificial
  20-mer unique DNA sequence
ggaaggggccgaaaacgcag

SEQ ID NO: 4482 - DNA, 20 bp, Artificial
  20-mer unique DNA sequence
tgacagcatcctgcaggcca

SEQ ID NO: 4483 - DNA, 20 bp, Artificial
  20-mer unique DNA sequence
cagactcaactggcctgggt

SEQ ID NO: 4484 - DNA, 20 bp, Artificial
  20-mer unique DNA sequence
attaccacgggggccgactg

SEQ ID NO: 4485 - DNA, 20 bp, Artificial
  20-mer unique DNA sequence
acgaggtgtgtgtgcggagc

SEQ ID NO: 4486 - DNA, 20 bp, Artificial
  20-mer unique DNA sequence
attccgcctcgtcccagctt

SEQ ID NO: 4487 - DNA, 20 bp, Artificial
  20-mer unique DNA sequence
cgcaggccgttggcaaaact

SEQ ID NO: 4488 - DNA, 20 bp, Artificial
  20-mer unique DNA sequence
ggccccagacgtaccaggaa

SEQ ID NO: 4489 - DNA, 20 bp, Artificial
  20-mer unique DNA sequence
atcccaccttagcccccggc

SEQ ID NO: 4490 - DNA, 20 bp, Artificial
  20-mer unique DNA sequence
acaacacgacgccgccagaa

SEQ ID NO: 4491 - DNA, 20 bp, Artificial
  20-mer unique DNA sequence
ctagcttgcggccggtttgg

SEQ ID NO: 4492 - DNA, 20 bp, Artificial
  20-mer unique DNA sequence
ggcaacacttcaccgagccg

SEQ ID NO: 4493 - DNA, 20 bp, Artificial
  20-mer unique DNA sequence
gtttaccgaacccccacggc

SEQ ID NO: 4494 - DNA, 20 bp, Artificial
  20-mer unique DNA sequence
atgcagttggtcctcggcag

SEQ ID NO: 4495 - DNA, 20 bp, Artificial
  20-mer unique DNA sequence
aagccgctcgacgatcagtg

SEQ ID NO: 4496 - DNA, 20 bp, Artificial
  20-mer unique DNA sequence
cgtgcgacttagttcccggt

SEQ ID NO: 4497 - DNA, 20 bp, Artificial
  20-mer unique DNA sequence
tggagctttcgcggctacaa

SEQ ID NO: 4498 - DNA, 20 bp, Artificial
  20-mer unique DNA sequence
atagtttcgacccgccgccg

SEQ ID NO: 4499 - DNA, 20 bp, Artificial
  20-mer unique DNA sequence
gggccctttcacttgcgata

SEQ ID NO: 4500 - DNA, 20 bp, Artificial
  20-mer unique DNA sequence
atacgggggagtgggtgcga

SEQ ID NO: 4501 - DNA, 20 bp, Artificial
  20-mer unique DNA sequence
agcaaaagcgggaaagcggg

SEQ ID NO: 4502 - DNA, 20 bp, Artificial
  20-mer unique DNA sequence
acccccatgtagcccgcagt

SEQ ID NO: 4503 - DNA, 20 bp, Artificial
  20-mer unique DNA sequence
ccacggggcttgcatcacaa

SEQ ID NO: 4504 - DNA, 20 bp, Artificial
  20-mer unique DNA sequence
gcaaccaatcggctaccgcg

SEQ ID NO: 4505 - DNA, 20 bp, Artificial
  20-mer unique DNA sequence
actgcggttagactcctggc

SEQ ID NO: 4506 - DNA, 20 bp, Artificial
  20-mer unique DNA sequence
gccccttgtctggtcccgtg

SEQ ID NO: 4507 - DNA, 20 bp, Artificial
  20-mer unique DNA sequence
caccctccctcgtctgctcg

SEQ ID NO: 4508 - DNA, 20 bp, Artificial
  20-mer unique DNA sequence
attccagcagggggtgggtt

SEQ ID NO: 4509 - DNA, 20 bp, Artificial
  20-mer unique DNA sequence
ccccccccgagaaacgacta

SEQ ID NO: 4510 - DNA, 20 bp, Artificial
  20-mer unique DNA sequence
caactgcgagaaccccccga

SEQ ID NO: 4511 - DNA, 20 bp, Artificial
  20-mer unique DNA sequence
ggggccggaagggatattgt

SEQ ID NO: 4512 - DNA, 20 bp, Artificial
  20-mer unique DNA sequence
agctaccctccggggcaata

SEQ ID NO: 4513 - DNA, 20 bp, Artificial
  20-mer unique DNA sequence
tggtctgacggcgtcgatga

SEQ ID NO: 4514 - DNA, 20 bp, Artificial
  20-mer unique DNA sequence
tggacgtaacgcggctacaa

SEQ ID NO: 4515 - DNA, 20 bp, Artificial
  20-mer unique DNA sequence
acactcgcggctgagtacaa

SEQ ID NO: 4516 - DNA, 20 bp, Artificial
  20-mer unique DNA sequence
ttatggctcccacggcggtg

SEQ ID NO: 4517 - DNA, 20 bp, Artificial
  20-mer unique DNA sequence
cgatgaagggtcgtacgggg

SEQ ID NO: 4518 - DNA, 20 bp, Artificial
  20-mer unique DNA sequence
gacgatggtagcccggtgat

SEQ ID NO: 4519 - DNA, 20 bp, Artificial
  20-mer unique DNA sequence
agctcccacccctgtccatg

SEQ ID NO: 4520 - DNA, 20 bp, Artificial
  20-mer unique DNA sequence
ctacaagagcggcgacccgt

SEQ ID NO: 4521 - DNA, 20 bp, Artificial
  20-mer unique DNA sequence
tcaaatcgctcttccgcgca

SEQ ID NO: 4522 - DNA, 20 bp, Artificial
  20-mer unique DNA sequence
cgcggcataaaacggccata

SEQ ID NO: 4523 - DNA, 20 bp, Artificial
  20-mer unique DNA sequence
tgcatccgaacagaaggata

SEQ ID NO: 4524 - DNA, 20 bp, Artificial
  20-mer unique DNA sequence
cggtatcgtcccgcttgtgg

SEQ ID NO: 4525 - DNA, 20 bp, Artificial
  20-mer unique DNA sequence
cgctctcccgaacccgcata

SEQ ID NO: 4526 - DNA, 20 bp, Artificial
  20-mer unique DNA sequence
tctggagcgacgaggggtca

SEQ ID NO: 4527 - DNA, 20 bp, Artificial
  20-mer unique DNA sequence
tggctgagggaggggcgagt

SEQ ID NO: 4528 - DNA, 20 bp, Artificial
  20-mer unique DNA sequence
atcgcactcccccactgacc

SEQ ID NO: 4529 - DNA, 20 bp, Artificial
  20-mer unique DNA sequence
tccgacaccgcgctctcaaa

SEQ ID NO: 4530 - DNA, 20 bp, Artificial
  20-mer unique DNA sequence
ggagggctgttgaagggacg

SEQ ID NO: 4531 - DNA, 20 bp, Artificial
  20-mer unique DNA sequence
tgcgtcccatccccttctgt

SEQ ID NO: 4532 - DNA, 20 bp, Artificial
  20-mer unique DNA sequence
tttcagcgcgcccactcttt

SEQ ID NO: 4533 - DNA, 20 bp, Artificial
  20-mer unique DNA sequence
gtttcgtattcgcgacggcc

SEQ ID NO: 4534 - DNA, 20 bp, Artificial
  20-mer unique DNA sequence
cagatggcgaggagggggtg

SEQ ID NO: 4535 - DNA, 20 bp, Artificial
  20-mer unique DNA sequence
tggagtcatgggggttgcag

SEQ ID NO: 4536 - DNA, 20 bp, Artificial
  20-mer unique DNA sequence
ccataaatccctcggtgcgc

SEQ ID NO: 4537 - DNA, 20 bp, Artificial
  20-mer unique DNA sequence
ggctcgtgttggatagggcg

SEQ ID NO: 4538 - DNA, 20 bp, Artificial
  20-mer unique DNA sequence
atggccgggtgcttctggaa

SEQ ID NO: 4539 - DNA, 20 bp, Artificial
  20-mer unique DNA sequence
cacaagatcaacgccgccgc

SEQ ID NO: 4540 - DNA, 20 bp, Artificial
  20-mer unique DNA sequence
tggatgtgtacgcgccgagg

SEQ ID NO: 4541 - DNA, 20 bp, Artificial
  20-mer unique DNA sequence
ataccgcgcgcctacatagc

SEQ ID NO: 4542 - DNA, 20 bp, Artificial
  20-mer unique DNA sequence
tgggaacaagccggggaagc

SEQ ID NO: 4543 - DNA, 20 bp, Artificial
  20-mer unique DNA sequence
taggttggcgccggaggtga

SEQ ID NO: 4544 - DNA, 20 bp, Artificial
  20-mer unique DNA sequence
tgtgatgcactgtcccgcca

SEQ ID NO: 4545 - DNA, 20 bp, Artificial
  20-mer unique DNA sequence
cggccgaggtgggttggtct

SEQ ID NO: 4546 - DNA, 20 bp, Artificial
  20-mer unique DNA sequence
tccagccaaacaaagcccgc

SEQ ID NO: 4547 - DNA, 20 bp, Artificial
  20-mer unique DNA sequence
ctctcgcaacccaaccgcct

SEQ ID NO: 4548 - DNA, 20 bp, Artificial
  20-mer unique DNA sequence
ttccgccctactcgtttccg

SEQ ID NO: 4549 - DNA, 20 bp, Artificial
  20-mer unique DNA sequence
cctccggaacaaatcgcctc

SEQ ID NO: 4550 - DNA, 20 bp, Artificial
  20-mer unique DNA sequence
cccagtgaaaccccaacgca

SEQ ID NO: 4551 - DNA, 20 bp, Artificial
  20-mer unique DNA sequence
tgtcctgcctccaccattcg

SEQ ID NO: 4552 - DNA, 20 bp, Artificial
  20-mer unique DNA sequence
aactggcgtctccgtgatga

SEQ ID NO: 4553 - DNA, 20 bp, Artificial
  20-mer unique DNA sequence
ctaacgtgccggctgtacaa

SEQ ID NO: 4554 - DNA, 20 bp, Artificial
  20-mer unique DNA sequence
tagacgcgcagcggagagcc

SEQ ID NO: 4555 - DNA, 20 bp, Artificial
  20-mer unique DNA sequence
agttgggtggtgaagcggcg

SEQ ID NO: 4556 - DNA, 20 bp, Artificial
  20-mer unique DNA sequence
acctgctgcttgtgcctcgc

SEQ ID NO: 4557 - DNA, 20 bp, Artificial
  20-mer unique DNA sequence
accccccacctttgctcgag

SEQ ID NO: 4558 - DNA, 20 bp, Artificial
  20-mer unique DNA sequence
gagttcgcaaggcccccagt

SEQ ID NO: 4559 - DNA, 20 bp, Artificial
  20-mer unique DNA sequence
ccagcccccctccactctcc

SEQ ID NO: 4560 - DNA, 20 bp, Artificial
  20-mer unique DNA sequence
gagcttctgcgtggggggta

SEQ ID NO: 4561 - DNA, 20 bp, Artificial
  20-mer unique DNA sequence
gtacgccccatccaagtcgc

SEQ ID NO: 4562 - DNA, 20 bp, Artificial
  20-mer unique DNA sequence
gcgagcgacttggcggtttg

SEQ ID NO: 4563 - DNA, 20 bp, Artificial
  20-mer unique DNA sequence
atgatggggttccgcggatt

SEQ ID NO: 4564 - DNA, 20 bp, Artificial
  20-mer unique DNA sequence
ccggttctcagcgttcccat

SEQ ID NO: 4565 - DNA, 20 bp, Artificial
  20-mer unique DNA sequence
ttttgaggtcgtgtcccggc

SEQ ID NO: 4566 - DNA, 20 bp, Artificial
  20-mer unique DNA sequence
ccgcctggaacttctgctcg

SEQ ID NO: 4567 - DNA, 20 bp, Artificial
  20-mer unique DNA sequence
taaacagccgagcccccacc

SEQ ID NO: 4568 - DNA, 20 bp, Artificial
  20-mer unique DNA sequence
taccgggtctcgctgtacaa

SEQ ID NO: 4569 - DNA, 20 bp, Artificial
  20-mer unique DNA sequence
agcgaactccgtacaccctg

SEQ ID NO: 4570 - DNA, 20 bp, Artificial
  20-mer unique DNA sequence
acgctgacggctgagttaca

SEQ ID NO: 4571 - DNA, 20 bp, Artificial
  20-mer unique DNA sequence
tgtacacggcgtcacgatga

SEQ ID NO: 4572 - DNA, 20 bp, Artificial
  20-mer unique DNA sequence
ttgaagatcctcgccaccgg

SEQ ID NO: 4573 - DNA, 20 bp, Artificial
  20-mer unique DNA sequence
cagaaaacacccgcaaggca

SEQ ID NO: 4574 - DNA, 20 bp, Artificial
  20-mer unique DNA sequence
tgggcgtcacaacaggatga

SEQ ID NO: 4575 - DNA, 20 bp, Artificial
  20-mer unique DNA sequence
gcacgttgacggctgtacaa

SEQ ID NO: 4576 - DNA, 20 bp, Artificial
  20-mer unique DNA sequence
ggggctccgggcattcagtc

SEQ ID NO: 4577 - DNA, 20 bp, Artificial
  20-mer unique DNA sequence
gcccaccttccgcacgacct

SEQ ID NO: 4578 - DNA, 20 bp, Artificial
  20-mer unique DNA sequence
aggctaccgtgtactgcgac

SEQ ID NO: 4579 - DNA, 20 bp, Artificial
  20-mer unique DNA sequence
aggcgggaagggcggtgtta

SEQ ID NO: 4580 - DNA, 20 bp, Artificial
  20-mer unique DNA sequence
gcggtcgcattgttgctctc

SEQ ID NO: 4581 - DNA, 20 bp, Artificial
  20-mer unique DNA sequence
cctctgacatgcccgccgta

SEQ ID NO: 4582 - DNA, 20 bp, Artificial
  20-mer unique DNA sequence
actgacacacccccgccaaa

SEQ ID NO: 4583 - DNA, 20 bp, Artificial
  20-mer unique DNA sequence
aaggaacggcggcagaaagg

SEQ ID NO: 4584 - DNA, 20 bp, Artificial
  20-mer unique DNA sequence
aagtgtgcccccaaaccgtc

SEQ ID NO: 4585 - DNA, 20 bp, Artificial
  20-mer unique DNA sequence
cgtcccttctcgcctgtcct

SEQ ID NO: 4586 - DNA, 20 bp, Artificial
  20-mer unique DNA sequence
actggttagcgcgtcgatga

SEQ ID NO: 4587 - DNA, 20 bp, Artificial
  20-mer unique DNA sequence
ggatgctcacgcgtcgatga

SEQ ID NO: 4588 - DNA, 20 bp, Artificial
  20-mer unique DNA sequence
ccaaaacccgggatgcgcta

SEQ ID NO: 4589 - DNA, 20 bp, Artificial
  20-mer unique DNA sequence
gccgcttgttcgacgttcag

SEQ ID NO: 4590 - DNA, 20 bp, Artificial
  20-mer unique DNA sequence
cgcaacacctctccaccccg

SEQ ID NO: 4591 - DNA, 20 bp, Artificial
  20-mer unique DNA sequence
atgcccaccctgttcctccg

SEQ ID NO: 4592 - DNA, 20 bp, Artificial
  20-mer unique DNA sequence
cgccatccacgaagacacca

SEQ ID NO: 4593 - DNA, 20 bp, Artificial
  20-mer unique DNA sequence
cagcttatgatgggggcggc

SEQ ID NO: 4594 - DNA, 20 bp, Artificial
  20-mer unique DNA sequence
gatgggctcgtggggtgaga

SEQ ID NO: 4595 - DNA, 20 bp, Artificial
  20-mer unique DNA sequence
gggtgcgggagtgttgtgga

SEQ ID NO: 4596 - DNA, 20 bp, Artificial
  20-mer unique DNA sequence
cgaaccggcacggggctatt

SEQ ID NO: 4597 - DNA, 20 bp, Artificial
  20-mer unique DNA sequence
cgggattggagagcgtgcac

SEQ ID NO: 4598 - DNA, 20 bp, Artificial
  20-mer unique DNA sequence
aggtctgcacggctgtacaa

SEQ ID NO: 4599 - DNA, 20 bp, Artificial
  20-mer unique DNA sequence
atagagcgccggctgtacaa

SEQ ID NO: 4600 - DNA, 20 bp, Artificial
  20-mer unique DNA sequence
ggaaggcaattgtcggcgtg

SEQ ID NO: 4601 - DNA, 20 bp, Artificial
  20-mer unique DNA sequence
cgcccttgcgagtttgggtg

SEQ ID NO: 4602 - DNA, 20 bp, Artificial
  20-mer unique DNA sequence
tccacatctcatcgcccacg

SEQ ID NO: 4603 - DNA, 20 bp, Artificial
  20-mer unique DNA sequence
gatacttggcggggcggcta

SEQ ID NO: 4604 - DNA, 20 bp, Artificial
  20-mer unique DNA sequence
ttgagcttgactggccccgg

SEQ ID NO: 4605 - DNA, 20 bp, Artificial
  20-mer unique DNA sequence
cgggcgtacaaggggacaca

SEQ ID NO: 4606 - DNA, 20 bp, Artificial
  20-mer unique DNA sequence
ggagtgcgggcggaaaaaag

SEQ ID NO: 4607 - DNA, 20 bp, Artificial
  20-mer unique DNA sequence
ttcagtcaccacccgccgat

SEQ ID NO: 4608 - DNA, 20 bp, Artificial
  20-mer unique DNA sequence
catgaggagttcgacgggca

SEQ ID NO: 4609 - DNA, 20 bp, Artificial
  20-mer unique DNA sequence
cgcagctcaaccgtcacccc

SEQ ID NO: 4610 - DNA, 20 bp, Artificial
  20-mer unique DNA sequence
gacccgacacacgcccagga

SEQ ID NO: 4611 - DNA, 20 bp, Artificial
  20-mer unique DNA sequence
atataacgtccccgcgcctg

SEQ ID NO: 4612 - DNA, 20 bp, Artificial
  20-mer unique DNA sequence
caaaacggcgagacgggaac

SEQ ID NO: 4613 - DNA, 20 bp, Artificial
  20-mer unique DNA sequence
ttggggtgggctgctaaggt

SEQ ID NO: 4614 - DNA, 20 bp, Artificial
  20-mer unique DNA sequence
caacccgtaaaatgcgccaa

SEQ ID NO: 4615 - DNA, 20 bp, Artificial
  20-mer unique DNA sequence
gggaggggatagcgacgagc

SEQ ID NO: 4616 - DNA, 20 bp, Artificial
  20-mer unique DNA sequence
cgacagacgacgaaaccgcc

SEQ ID NO: 4617 - DNA, 20 bp, Artificial
  20-mer unique DNA sequence
gcaccacgcgaacaacccta

SEQ ID NO: 4618 - DNA, 20 bp, Artificial
  20-mer unique DNA sequence
gtcccggcgattcagagcct

SEQ ID NO: 4619 - DNA, 20 bp, Artificial
  20-mer unique DNA sequence
ggcagctgtgggaggtaccc

SEQ ID NO: 4620 - DNA, 20 bp, Artificial
  20-mer unique DNA sequence
ctccaaacaccctcccgcgt

SEQ ID NO: 4621 - DNA, 20 bp, Artificial
  20-mer unique DNA sequence
ccctgaaccccctgctatgc

SEQ ID NO: 4622 - DNA, 20 bp, Artificial
  20-mer unique DNA sequence
ggcttgctcgggggttcact

SEQ ID NO: 4623 - DNA, 20 bp, Artificial
  20-mer unique DNA sequence
aaggtggaacagcgagcccc

SEQ ID NO: 4624 - DNA, 20 bp, Artificial
  20-mer unique DNA sequence
catgcggcgtcccatgatga

SEQ ID NO: 4625 - DNA, 20 bp, Artificial
  20-mer unique DNA sequence
tgggttcaacgcggctacaa

SEQ ID NO: 4626 - DNA, 20 bp, Artificial
  20-mer unique DNA sequence
aacgcctcacctcccaacca

SEQ ID NO: 4627 - DNA, 20 bp, Artificial
  20-mer unique DNA sequence
gctgggaaagcgagggtgtc

SEQ ID NO: 4628 - DNA, 20 bp, Artificial
  20-mer unique DNA sequence
ccaggatcgcgctgctacaa

SEQ ID NO: 4629 - DNA, 20 bp, Artificial
  20-mer unique DNA sequence
gtagttcattggcgcgcagc

SEQ ID NO: 4630 - DNA, 20 bp, Artificial
  20-mer unique DNA sequence
cgggtttgagcgtgcgatta

SEQ ID NO: 4631 - DNA, 20 bp, Artificial
  20-mer unique DNA sequence
gcgcagaggttcaaaagggg

SEQ ID NO: 4632 - DNA, 20 bp, Artificial
  20-mer unique DNA sequence
acctccgcaatccgctttca

SEQ ID NO: 4633 - DNA, 20 bp, Artificial
  20-mer unique DNA sequence
tacacagccagaaccgccga

SEQ ID NO: 4634 - DNA, 20 bp, Artificial
  20-mer unique DNA sequence
tgtgttccgcctgttgcctg

SEQ ID NO: 4635 - DNA, 20 bp, Artificial
  20-mer unique DNA sequence
ggtgggaatgaggtgaggcg

SEQ ID NO: 4636 - DNA, 20 bp, Artificial
  20-mer unique DNA sequence
cagcagcccacttcctcgga

SEQ ID NO: 4637 - DNA, 20 bp, Artificial
  20-mer unique DNA sequence
gcgccggtgatttcggatct

SEQ ID NO: 4638 - DNA, 20 bp, Artificial
  20-mer unique DNA sequence
cccgatgctctcccgtccaa

SEQ ID NO: 4639 - DNA, 20 bp, Artificial
  20-mer unique DNA sequence
ggcgttattggtgctgcgag

SEQ ID NO: 4640 - DNA, 20 bp, Artificial
  20-mer unique DNA sequence
ccgttcccctcacatacgcc

SEQ ID NO: 4641 - DNA, 20 bp, Artificial
  20-mer unique DNA sequence
gattgggcgggttaggcgaa

SEQ ID NO: 4642 - DNA, 20 bp, Artificial
  20-mer unique DNA sequence
actctaggcgtcgcggatga

SEQ ID NO: 4643 - DNA, 20 bp, Artificial
  20-mer unique DNA sequence
gtctggacatccggcgatga

SEQ ID NO: 4644 - DNA, 20 bp, Artificial
  20-mer unique DNA sequence
ttggggcctcttgtcgctct

SEQ ID NO: 4645 - DNA, 20 bp, Artificial
  20-mer unique DNA sequence
aggctcatccactcgctgca

SEQ ID NO: 4646 - DNA, 20 bp, Artificial
  20-mer unique DNA sequence
aagaggggggttcgtcagca

SEQ ID NO: 4647 - DNA, 20 bp, Artificial
  20-mer unique DNA sequence
ggcggcataggcgagtaggg

SEQ ID NO: 4648 - DNA, 20 bp, Artificial
  20-mer unique DNA sequence
ctttgcctgcgcgggttcta

SEQ ID NO: 4649 - DNA, 20 bp, Artificial
  20-mer unique DNA sequence
tgcatctgcgctgaatcctt

SEQ ID NO: 4650 - DNA, 20 bp, Artificial
  20-mer unique DNA sequence
gctgggaacgggacgcaaga

SEQ ID NO: 4651 - DNA, 20 bp, Artificial
  20-mer unique DNA sequence
tggggtgcggccttctaaag

SEQ ID NO: 4652 - DNA, 20 bp, Artificial
  20-mer unique DNA sequence
cagaacatgtcgcagtgccg

SEQ ID NO: 4653 - DNA, 20 bp, Artificial
  20-mer unique DNA sequence
actgcagcccgctgctacaa

SEQ ID NO: 4654 - DNA, 20 bp, Artificial
  20-mer unique DNA sequence
tcgacatgccgcacgagtgt

SEQ ID NO: 4655 - DNA, 20 bp, Artificial
  20-mer unique DNA sequence
gctccagtcaggtgatcgct

SEQ ID NO: 4656 - DNA, 20 bp, Artificial
  20-mer unique DNA sequence
gcccccacccgaagacaagc

SEQ ID NO: 4657 - DNA, 20 bp, Artificial
  20-mer unique DNA sequence
tcggagatgaatcgggccct

SEQ ID NO: 4658 - DNA, 20 bp, Artificial
  20-mer unique DNA sequence
ttgttgtacggcgctggggc

SEQ ID NO: 4659 - DNA, 20 bp, Artificial
  20-mer unique DNA sequence
ctgaaggtttttgggggcgg

SEQ ID NO: 4660 - DNA, 20 bp, Artificial
  20-mer unique DNA sequence
ttcgttctcgcggatggttg

SEQ ID NO: 4661 - DNA, 20 bp, Artificial
  20-mer unique DNA sequence
ctgtttcgcgccacgtgtcc

SEQ ID NO: 4662 - DNA, 20 bp, Artificial
  20-mer unique DNA sequence
tggtgttgccgactgcgctt

SEQ ID NO: 4663 - DNA, 20 bp, Artificial
  20-mer unique DNA sequence
cccattggtgcacgtccggt

SEQ ID NO: 4664 - DNA, 20 bp, Artificial
  20-mer unique DNA sequence
tcaacttcgctgctgccgtg

SEQ ID NO: 4665 - DNA, 20 bp, Artificial
  20-mer unique DNA sequence
ctacgctgggtgcggaccgt

SEQ ID NO: 4666 - DNA, 20 bp, Artificial
  20-mer unique DNA sequence
cataagcgccaatcccccaa

SEQ ID NO: 4667 - DNA, 20 bp, Artificial
  20-mer unique DNA sequence
gggtggcttggatgtttggc

SEQ ID NO: 4668 - DNA, 20 bp, Artificial
  20-mer unique DNA sequence
gctaccagagaaggccgccc

SEQ ID NO: 4669 - DNA, 20 bp, Artificial
  20-mer unique DNA sequence
gccggttccgaccaactctc

SEQ ID NO: 4670 - DNA, 20 bp, Artificial
  20-mer unique DNA sequence
cgttcatccccttcaccgca

SEQ ID NO: 4671 - DNA, 20 bp, Artificial
  20-mer unique DNA sequence
tacgggggggcagttcaggg

SEQ ID NO: 4672 - DNA, 20 bp, Artificial
  20-mer unique DNA sequence
cccagccccagaacaacggt

SEQ ID NO: 4673 - DNA, 20 bp, Artificial
  20-mer unique DNA sequence
agccctttcagtccccgcct

SEQ ID NO: 4674 - DNA, 20 bp, Artificial
  20-mer unique DNA sequence
cggcgtgtgcgtagggtgtg

SEQ ID NO: 4675 - DNA, 20 bp, Artificial
  20-mer unique DNA sequence
cggcgatagtggagtttcaa

SEQ ID NO: 4676 - DNA, 20 bp, Artificial
  20-mer unique DNA sequence
accactcaatcacgcccggg

SEQ ID NO: 4677 - DNA, 20 bp, Artificial
  20-mer unique DNA sequence
ggaccgcctttacctgcccc

SEQ ID NO: 4678 - DNA, 20 bp, Artificial
  20-mer unique DNA sequence
agagcaggtttcggtgcggc

SEQ ID NO: 4679 - DNA, 20 bp, Artificial
  20-mer unique DNA sequence
acagcggggcgaaaaagtcc

SEQ ID NO: 4680 - DNA, 20 bp, Artificial
  20-mer unique DNA sequence
gttcgtgatgcccgggttga

SEQ ID NO: 4681 - DNA, 20 bp, Artificial
  20-mer unique DNA sequence
aggccccgaaacaaaccgct

SEQ ID NO: 4682 - DNA, 20 bp, Artificial
  20-mer unique DNA sequence
acgcgggtccatactgaggc

SEQ ID NO: 4683 - DNA, 20 bp, Artificial
  20-mer unique DNA sequence
atagcggcgtggtggaggca

SEQ ID NO: 4684 - DNA, 20 bp, Artificial
  20-mer unique DNA sequence
gcgagtggcaggcggacagt

SEQ ID NO: 4685 - DNA, 20 bp, Artificial
  20-mer unique DNA sequence
gcaatggggcgtcgttacct

SEQ ID NO: 4686 - DNA, 20 bp, Artificial
  20-mer unique DNA sequence
gcaggcgagggactggttgt

SEQ ID NO: 4687 - DNA, 20 bp, Artificial
  20-mer unique DNA sequence
cgtgcgtgtttgtcgctccc

SEQ ID NO: 4688 - DNA, 20 bp, Artificial
  20-mer unique DNA sequence
tgcatttctctagcgcggcg

SEQ ID NO: 4689 - DNA, 20 bp, Artificial
  20-mer unique DNA sequence
tccaggtgcgcgtttcgttc

SEQ ID NO: 4690 - DNA, 20 bp, Artificial
  20-mer unique DNA sequence
actatgcgtttggaccgggc

SEQ ID NO: 4691 - DNA, 20 bp, Artificial
  20-mer unique DNA sequence
agaggtagggcgcatggggg

SEQ ID NO: 4692 - DNA, 20 bp, Artificial
  20-mer unique DNA sequence
gctggtggactcccgtacaa

SEQ ID NO: 4693 - DNA, 20 bp, Artificial
  20-mer unique DNA sequence
catcctgggaggcgtgatga

SEQ ID NO: 4694 - DNA, 20 bp, Artificial
  20-mer unique DNA sequence
ttcgtccctgtcgtgccgcg

SEQ ID NO: 4695 - DNA, 20 bp, Artificial
  20-mer unique DNA sequence
ttcgcgggcccacatcttca

SEQ ID NO: 4696 - DNA, 20 bp, Artificial
  20-mer unique DNA sequence
aacggcgtgggaattctgcg

SEQ ID NO: 4697 - DNA, 20 bp, Artificial
  20-mer unique DNA sequence
cactggctacttgggtcgcg

SEQ ID NO: 4698 - DNA, 20 bp, Artificial
  20-mer unique DNA sequence
ccaaatatcgctgccggctg

SEQ ID NO: 4699 - DNA, 20 bp, Artificial
  20-mer unique DNA sequence
agtaacgggattggcggctg

SEQ ID NO: 4700 - DNA, 20 bp, Artificial
  20-mer unique DNA sequence
gcggcaccagaaatcgaacg

SEQ ID NO: 4701 - DNA, 20 bp, Artificial
  20-mer unique DNA sequence
atcggaaacccccaagcgtg

SEQ ID NO: 4702 - DNA, 20 bp, Artificial
  20-mer unique DNA sequence
tcccgacacgaaagcaccag

SEQ ID NO: 4703 - DNA, 20 bp, Artificial
  20-mer unique DNA sequence
cgctataggtccgccccgaa

SEQ ID NO: 4704 - DNA, 20 bp, Artificial
  20-mer unique DNA sequence
agctttgagtgtccccggtg

SEQ ID NO: 4705 - DNA, 20 bp, Artificial
  20-mer unique DNA sequence
tggggaacggagccacatgt

SEQ ID NO: 4706 - DNA, 20 bp, Artificial
  20-mer unique DNA sequence
cagcagcggaaagggcgaat

SEQ ID NO: 4707 - DNA, 20 bp, Artificial
  20-mer unique DNA sequence
tggtggtgtcccggtggtct

SEQ ID NO: 4708 - DNA, 20 bp, Artificial
  20-mer unique DNA sequence
caggaggtgggacgcaaagc

SEQ ID NO: 4709 - DNA, 20 bp, Artificial
  20-mer unique DNA sequence
gcccaacccgacatcttccc

SEQ ID NO: 4710 - DNA, 20 bp, Artificial
  20-mer unique DNA sequence
tgatggatagctcgccgggt

SEQ ID NO: 4711 - DNA, 20 bp, Artificial
  20-mer unique DNA sequence
ggagattggcggggatgtgg

SEQ ID NO: 4712 - DNA, 20 bp, Artificial
  20-mer unique DNA sequence
ggtaagcatgcggtgggcct

SEQ ID NO: 4713 - DNA, 20 bp, Artificial
  20-mer unique DNA sequence
tagcaaggggccggtcgaaa

SEQ ID NO: 4714 - DNA, 20 bp, Artificial
  20-mer unique DNA sequence
agggggcgtgggattgaaag

SEQ ID NO: 4715 - DNA, 20 bp, Artificial
  20-mer unique DNA sequence
cacaacggaagggcagcaag

SEQ ID NO: 4716 - DNA, 20 bp, Artificial
  20-mer unique DNA sequence
cgaaacgagacgggcgagaa

SEQ ID NO: 4717 - DNA, 20 bp, Artificial
  20-mer unique DNA sequence
tcggacgggcagggactact

SEQ ID NO: 4718 - DNA, 20 bp, Artificial
  20-mer unique DNA sequence
acttcacgtgctgctcccga

SEQ ID NO: 4719 - DNA, 20 bp, Artificial
  20-mer unique DNA sequence
acttgtgcagggttcggccg

SEQ ID NO: 4720 - DNA, 20 bp, Artificial
  20-mer unique DNA sequence
ctgcttgggctggagttgcg

SEQ ID NO: 4721 - DNA, 20 bp, Artificial
  20-mer unique DNA sequence
gtcgtctcccttcgctccca

SEQ ID NO: 4722 - DNA, 20 bp, Artificial
  20-mer unique DNA sequence
cggatagagggcgacagggt

SEQ ID NO: 4723 - DNA, 20 bp, Artificial
  20-mer unique DNA sequence
taaagtatgggacgcgcggc

SEQ ID NO: 4724 - DNA, 20 bp, Artificial
  20-mer unique DNA sequence
tctccacgccaccccctaac

SEQ ID NO: 4725 - DNA, 20 bp, Artificial
  20-mer unique DNA sequence
gcgtggatttgcggggtgtt

SEQ ID NO: 4726 - DNA, 20 bp, Artificial
  20-mer unique DNA sequence
aatgtggctagggttcggcg

SEQ ID NO: 4727 - DNA, 20 bp, Artificial
  20-mer unique DNA sequence
agcctgccgctcctggctag

SEQ ID NO: 4728 - DNA, 20 bp, Artificial
  20-mer unique DNA sequence
acaataaccccccctgccga

SEQ ID NO: 4729 - DNA, 20 bp, Artificial
  20-mer unique DNA sequence
ccgccccgtacaagccagaa

SEQ ID NO: 4730 - DNA, 20 bp, Artificial
  20-mer unique DNA sequence
ctccggcattgtaacgctgc

SEQ ID NO: 4731 - DNA, 20 bp, Artificial
  20-mer unique DNA sequence
ggcgaatgtggggcggaaat

SEQ ID NO: 4732 - DNA, 20 bp, Artificial
  20-mer unique DNA sequence
tggtgtcttctgagggggcg

SEQ ID NO: 4733 - DNA, 20 bp, Artificial
  20-mer unique DNA sequence
aggcccaggatgcaccaacg

SEQ ID NO: 4734 - DNA, 20 bp, Artificial
  20-mer unique DNA sequence
tttcaccccgtcctcggtct

SEQ ID NO: 4735 - DNA, 20 bp, Artificial
  20-mer unique DNA sequence
cctcgccccgcctcctgaaa

SEQ ID NO: 4736 - DNA, 20 bp, Artificial
  20-mer unique DNA sequence
acagcgggaggcactatcgg

SEQ ID NO: 4737 - DNA, 20 bp, Artificial
  20-mer unique DNA sequence
gcccccatccctagtcccag

SEQ ID NO: 4738 - DNA, 20 bp, Artificial
  20-mer unique DNA sequence
atgggcgttccgtgagtgtg

SEQ ID NO: 4739 - DNA, 20 bp, Artificial
  20-mer unique DNA sequence
ctggggacattgggaacggc

SEQ ID NO: 4740 - DNA, 20 bp, Artificial
  20-mer unique DNA sequence
accggcaaagcaaccacctc

SEQ ID NO: 4741 - DNA, 20 bp, Artificial
  20-mer unique DNA sequence
tttatcgaggccaacgcgca

SEQ ID NO: 4742 - DNA, 20 bp, Artificial
  20-mer unique DNA sequence
tggtagtcgcgggggaaatg

SEQ ID NO: 4743 - DNA, 20 bp, Artificial
  20-mer unique DNA sequence
cggttgggctcggtggattc

SEQ ID NO: 4744 - DNA, 20 bp, Artificial
  20-mer unique DNA sequence
acccgcagaaatgcaaccct

SEQ ID NO: 4745 - DNA, 20 bp, Artificial
  20-mer unique DNA sequence
gtctaacgcgagcggggagt

SEQ ID NO: 4746 - DNA, 20 bp, Artificial
  20-mer unique DNA sequence
ttgcgggggccttcattggt

SEQ ID NO: 4747 - DNA, 20 bp, Artificial
  20-mer unique DNA sequence
cgcgttcaggctcagggtgc

SEQ ID NO: 4748 - DNA, 20 bp, Artificial
  20-mer unique DNA sequence
gaaggccccgtgtgtcgagc

SEQ ID NO: 4749 - DNA, 20 bp, Artificial
  20-mer unique DNA sequence
ccaccaattgctgccccttg

SEQ ID NO: 4750 - DNA, 20 bp, Artificial
  20-mer unique DNA sequence
tgggggttctcacgtgggct

SEQ ID NO: 4751 - DNA, 20 bp, Artificial
  20-mer unique DNA sequence
gtgcccgaattcaagccagg

SEQ ID NO: 4752 - DNA, 20 bp, Artificial
  20-mer unique DNA sequence
catacctcggcgtcggatga

SEQ ID NO: 4753 - DNA, 20 bp, Artificial
  20-mer unique DNA sequence
gatgtgacgggcggtcgatg

SEQ ID NO: 4754 - DNA, 20 bp, Artificial
  20-mer unique DNA sequence
cggaggaacgccaattgaca

SEQ ID NO: 4755 - DNA, 20 bp, Artificial
  20-mer unique DNA sequence
ccgacaaccgcaccaaccgt

SEQ ID NO: 4756 - DNA, 20 bp, Artificial
  20-mer unique DNA sequence
agtggcgtggaaggggagca

SEQ ID NO: 4757 - DNA, 20 bp, Artificial
  20-mer unique DNA sequence
tctttcgtggttctcccgcc

SEQ ID NO: 4758 - DNA, 20 bp, Artificial
  20-mer unique DNA sequence
ggaaggtgggatgaaagtcg

SEQ ID NO: 4759 - DNA, 20 bp, Artificial
  20-mer unique DNA sequence
tgaaggagtcgcaaaatcga

SEQ ID NO: 4760 - DNA, 20 bp, Artificial
  20-mer unique DNA sequence
cgctcacccttgctttgccg

SEQ ID NO: 4761 - DNA, 20 bp, Artificial
  20-mer unique DNA sequence
gtgggggcaagcggataaag

SEQ ID NO: 4762 - DNA, 20 bp, Artificial
  20-mer unique DNA sequence
ctgcgccttttgggggaacg

SEQ ID NO: 4763 - DNA, 20 bp, Artificial
  20-mer unique DNA sequence
accggaacagcaccctccaa

SEQ ID NO: 4764 - DNA, 20 bp, Artificial
  20-mer unique DNA sequence
gcgggcggtagaaagacggg

SEQ ID NO: 4765 - DNA, 20 bp, Artificial
  20-mer unique DNA sequence
ggggaggaatcggtgaagcc

SEQ ID NO: 4766 - DNA, 20 bp, Artificial
  20-mer unique DNA sequence
tcacgtacggacccggcaat

SEQ ID NO: 4767 - DNA, 20 bp, Artificial
  20-mer unique DNA sequence
attgcctaacggtgcccgaa

SEQ ID NO: 4768 - DNA, 20 bp, Artificial
  20-mer unique DNA sequence
ggacgcctttacgagccagg

SEQ ID NO: 4769 - DNA, 20 bp, Artificial
  20-mer unique DNA sequence
gcatcggtgccctaacaggc

SEQ ID NO: 4770 - DNA, 20 bp, Artificial
  20-mer unique DNA sequence
gcccctcattgtcacgccat

SEQ ID NO: 4771 - DNA, 20 bp, Artificial
  20-mer unique DNA sequence
acggtgggagtggagacggg

SEQ ID NO: 4772 - DNA, 20 bp, Artificial
  20-mer unique DNA sequence
cccacaaccccccccaagag

SEQ ID NO: 4773 - DNA, 20 bp, Artificial
  20-mer unique DNA sequence
gaataacggggcttggggca

SEQ ID NO: 4774 - DNA, 20 bp, Artificial
  20-mer unique DNA sequence
cccgcattaccgccactctc

SEQ ID NO: 4775 - DNA, 20 bp, Artificial
  20-mer unique DNA sequence
gccgtgtgctttcgctgtgt

SEQ ID NO: 4776 - DNA, 20 bp, Artificial
  20-mer unique DNA sequence
tgcgtgggtaaagtgtacgg

SEQ ID NO: 4777 - DNA, 20 bp, Artificial
  20-mer unique DNA sequence
ggatgtgctcgccgtgagtc

SEQ ID NO: 4778 - DNA, 20 bp, Artificial
  20-mer unique DNA sequence
gaacctccccggtcagctgc

SEQ ID NO: 4779 - DNA, 20 bp, Artificial
  20-mer unique DNA sequence
cagtaccgccttctccgcct

SEQ ID NO: 4780 - DNA, 20 bp, Artificial
  20-mer unique DNA sequence
tcaactagccccaccgaccc

SEQ ID NO: 4781 - DNA, 20 bp, Artificial
  20-mer unique DNA sequence
gttccccccgtgatcgacaa

SEQ ID NO: 4782 - DNA, 20 bp, Artificial
  20-mer unique DNA sequence
catcccacgcacagaaacaa

SEQ ID NO: 4783 - DNA, 20 bp, Artificial
  20-mer unique DNA sequence
atttcgtcttgcggggcttc

SEQ ID NO: 4784 - DNA, 20 bp, Artificial
  20-mer unique DNA sequence
gtggtgctgctgctcgggaa

SEQ ID NO: 4785 - DNA, 20 bp, Artificial
  20-mer unique DNA sequence
gtccccatcatcaccgcgtt

SEQ ID NO: 4786 - DNA, 20 bp, Artificial
  20-mer unique DNA sequence
cgcccgcatgcttattctca

SEQ ID NO: 4787 - DNA, 20 bp, Artificial
  20-mer unique DNA sequence
tgtcgcctaggccccaaaga

SEQ ID NO: 4788 - DNA, 20 bp, Artificial
  20-mer unique DNA sequence
atactcgccgagggaacgcg

SEQ ID NO: 4789 - DNA, 20 bp, Artificial
  20-mer unique DNA sequence
tggctttaccgagacggcgg

SEQ ID NO: 4790 - DNA, 20 bp, Artificial
  20-mer unique DNA sequence
aaatttttgcgggaaggggg

SEQ ID NO: 4791 - DNA, 20 bp, Artificial
  20-mer unique DNA sequence
gtacccgccttcacccaccg

SEQ ID NO: 4792 - DNA, 20 bp, Artificial
  20-mer unique DNA sequence
cttgaagtcgtccgccgtgc

SEQ ID NO: 4793 - DNA, 20 bp, Artificial
  20-mer unique DNA sequence
gccttgtgcgccgttctctt

SEQ ID NO: 4794 - DNA, 20 bp, Artificial
  20-mer unique DNA sequence
tgcgctgtgcctcgtgattg

SEQ ID NO: 4795 - DNA, 20 bp, Artificial
  20-mer unique DNA sequence
cctagaaaccacggtcagag

SEQ ID NO: 4796 - DNA, 20 bp, Artificial
  20-mer unique DNA sequence
gagctgctgcacacccccag

SEQ ID NO: 4797 - DNA, 20 bp, Artificial
  20-mer unique DNA sequence
ttatcggaaatcggccacgc

SEQ ID NO: 4798 - DNA, 20 bp, Artificial
  20-mer unique DNA sequence
cccaccctctcaccctcgct

SEQ ID NO: 4799 - DNA, 20 bp, Artificial
  20-mer unique DNA sequence
tgcggaatcggtggttcggt

SEQ ID NO: 4800 - DNA, 20 bp, Artificial
  20-mer unique DNA sequence
gtggcggtcgggcgtttaga

SEQ ID NO: 4801 - DNA, 20 bp, Artificial
  20-mer unique DNA sequence
gaacaaatgaggggcgggca

SEQ ID NO: 4802 - DNA, 20 bp, Artificial
  20-mer unique DNA sequence
ctagccaacgaccccctccg

SEQ ID NO: 4803 - DNA, 20 bp, Artificial
  20-mer unique DNA sequence
gagtcgccgggttaagtggg

SEQ ID NO: 4804 - DNA, 20 bp, Artificial
  20-mer unique DNA sequence
gttcaatgctccgccacgca

SEQ ID NO: 4805 - DNA, 20 bp, Artificial
  20-mer unique DNA sequence
accccgccccgtatcctatc

SEQ ID NO: 4806 - DNA, 20 bp, Artificial
  20-mer unique DNA sequence
aaagggacgacggcagggat

SEQ ID NO: 4807 - DNA, 20 bp, Artificial
  20-mer unique DNA sequence
aacacaatcatcgcccccca

SEQ ID NO: 4808 - DNA, 20 bp, Artificial
  20-mer unique DNA sequence
tcccttgttcgcgccactgt

SEQ ID NO: 4809 - DNA, 20 bp, Artificial
  20-mer unique DNA sequence
acggatcagcgcccagaagg

SEQ ID NO: 4810 - DNA, 20 bp, Artificial
  20-mer unique DNA sequence
tcttgttcctgtcgcgtgtg

SEQ ID NO: 4811 - DNA, 20 bp, Artificial
  20-mer unique DNA sequence
cgccacgcctcacaccatgt

SEQ ID NO: 4812 - DNA, 20 bp, Artificial
  20-mer unique DNA sequence
tggaccccgcgcaatctgag

SEQ ID NO: 4813 - DNA, 20 bp, Artificial
  20-mer unique DNA sequence
acttgcgtctggcgggctac

SEQ ID NO: 4814 - DNA, 20 bp, Artificial
  20-mer unique DNA sequence
cgctgacaaaagcctcggcc

SEQ ID NO: 4815 - DNA, 20 bp, Artificial
  20-mer unique DNA sequence
gagcagtcgcaacccaccgg

SEQ ID NO: 4816 - DNA, 20 bp, Artificial
  20-mer unique DNA sequence
cagagtggcgcaacgacggt

SEQ ID NO: 4817 - DNA, 20 bp, Artificial
  20-mer unique DNA sequence
cgcaggccgctacgtcattc

SEQ ID NO: 4818 - DNA, 20 bp, Artificial
  20-mer unique DNA sequence
acgctcgcacaccccactca

SEQ ID NO: 4819 - DNA, 20 bp, Artificial
  20-mer unique DNA sequence
tcctgtttggcctggctgga

SEQ ID NO: 4820 - DNA, 20 bp, Artificial
  20-mer unique DNA sequence
atgggaagggtgcactgcgg

SEQ ID NO: 4821 - DNA, 20 bp, Artificial
  20-mer unique DNA sequence
gggcctcgacggaactagca

SEQ ID NO: 4822 - DNA, 20 bp, Artificial
  20-mer unique DNA sequence
cggtcaagaatcggcatggg

SEQ ID NO: 4823 - DNA, 20 bp, Artificial
  20-mer unique DNA sequence
caaaaaggggcgagagcggc

SEQ ID NO: 4824 - DNA, 20 bp, Artificial
  20-mer unique DNA sequence
ccgcaataccgcgttaccct

SEQ ID NO: 4825 - DNA, 20 bp, Artificial
  20-mer unique DNA sequence
ttcggaagggagaagccgcc

SEQ ID NO: 4826 - DNA, 20 bp, Artificial
  20-mer unique DNA sequence
gactcggggcttgggtgaag

SEQ ID NO: 4827 - DNA, 20 bp, Artificial
  20-mer unique DNA sequence
atctgtcggtcggctcctgg

SEQ ID NO: 4828 - DNA, 20 bp, Artificial
  20-mer unique DNA sequence
tgtgtcacgcaggtgcacta

SEQ ID NO: 4829 - DNA, 20 bp, Artificial
  20-mer unique DNA sequence
accatccggacggctctttg

SEQ ID NO: 4830 - DNA, 20 bp, Artificial
  20-mer unique DNA sequence
gcgggacctttgctgcacgt

SEQ ID NO: 4831 - DNA, 20 bp, Artificial
  20-mer unique DNA sequence
cgacatctcggcaaagcggc

SEQ ID NO: 4832 - DNA, 20 bp, Artificial
  20-mer unique DNA sequence
tagcgttcgagtcccgggtt

SEQ ID NO: 4833 - DNA, 20 bp, Artificial
  20-mer unique DNA sequence
tgctcctccgtgcctgctca

SEQ ID NO: 4834 - DNA, 20 bp, Artificial
  20-mer unique DNA sequence
acccactccgcaccctgtca

SEQ ID NO: 4835 - DNA, 20 bp, Artificial
  20-mer unique DNA sequence
gatgtcctgtctcccgcgcc

SEQ ID NO: 4836 - DNA, 20 bp, Artificial
  20-mer unique DNA sequence
cgttgttccctggtcccgca

SEQ ID NO: 4837 - DNA, 20 bp, Artificial
  20-mer unique DNA sequence
ccgcagccctaacccaatgt

SEQ ID NO: 4838 - DNA, 20 bp, Artificial
  20-mer unique DNA sequence
atgcgccgactactaacccg

SEQ ID NO: 4839 - DNA, 20 bp, Artificial
  20-mer unique DNA sequence
agaccggaaccggacgtaca

SEQ ID NO: 4840 - DNA, 20 bp, Artificial
  20-mer unique DNA sequence
ggtcgtttcgtttcgcggtt

SEQ ID NO: 4841 - DNA, 20 bp, Artificial
  20-mer unique DNA sequence
tccccagcacaagaccgcaa

SEQ ID NO: 4842 - DNA, 20 bp, Artificial
  20-mer unique DNA sequence
tcgtccctgcgcctttatga

SEQ ID NO: 4843 - DNA, 20 bp, Artificial
  20-mer unique DNA sequence
tgcctgcgcgtacgtttttc

SEQ ID NO: 4844 - DNA, 20 bp, Artificial
  20-mer unique DNA sequence
agggggcgcggttgcatata

SEQ ID NO: 4845 - DNA, 20 bp, Artificial
  20-mer unique DNA sequence
ggacgttatagcggcgaggc

SEQ ID NO: 4846 - DNA, 20 bp, Artificial
  20-mer unique DNA sequence
cgcgaccctcacccattcct

SEQ ID NO: 4847 - DNA, 20 bp, Artificial
  20-mer unique DNA sequence
caagtgcatcatcggcccgt

SEQ ID NO: 4848 - DNA, 20 bp, Artificial
  20-mer unique DNA sequence
gaacagacccgccgatccct

SEQ ID NO: 4849 - DNA, 20 bp, Artificial
  20-mer unique DNA sequence
tcctgcaaccctctcgaatt

SEQ ID NO: 4850 - DNA, 20 bp, Artificial
  20-mer unique DNA sequence
gcgaggctcagactaccgaa

SEQ ID NO: 4851 - DNA, 20 bp, Artificial
  20-mer unique DNA sequence
gatttccttccgcggcagct

SEQ ID NO: 4852 - DNA, 20 bp, Artificial
  20-mer unique DNA sequence
tgccctcaccacgcactcaa

SEQ ID NO: 4853 - DNA, 20 bp, Artificial
  20-mer unique DNA sequence
atcggtcaggggttagcggg

SEQ ID NO: 4854 - DNA, 20 bp, Artificial
  20-mer unique DNA sequence
gcgagcgaaggtagtcggga

SEQ ID NO: 4855 - DNA, 20 bp, Artificial
  20-mer unique DNA sequence
cccgcagcgatcagttcccc

SEQ ID NO: 4856 - DNA, 20 bp, Artificial
  20-mer unique DNA sequence
ggcaacaagcagcaaagcgg

SEQ ID NO: 4857 - DNA, 20 bp, Artificial
  20-mer unique DNA sequence
tggtgtatgcatcgggggcc

SEQ ID NO: 4858 - DNA, 20 bp, Artificial
  20-mer unique DNA sequence
ctggcacccccggcttttta

SEQ ID NO: 4859 - DNA, 20 bp, Artificial
  20-mer unique DNA sequence
tgggaacattttgggccacg

SEQ ID NO: 4860 - DNA, 20 bp, Artificial
  20-mer unique DNA sequence
ctgtctagcggcggccatct

SEQ ID NO: 4861 - DNA, 20 bp, Artificial
  20-mer unique DNA sequence
cctaacggggaagggtccgc

SEQ ID NO: 4862 - DNA, 20 bp, Artificial
  20-mer unique DNA sequence
gcggcaaggaggtgtggcta

SEQ ID NO: 4863 - DNA, 20 bp, Artificial
  20-mer unique DNA sequence
ggcacaaagcgaggggaaca

SEQ ID NO: 4864 - DNA, 20 bp, Artificial
  20-mer unique DNA sequence
tccgtcgggctcaaaaacct

SEQ ID NO: 4865 - DNA, 20 bp, Artificial
  20-mer unique DNA sequence
tccgcccgcccatctttctc

SEQ ID NO: 4866 - DNA, 20 bp, Artificial
  20-mer unique DNA sequence
cacttggatcgcccccctgt

SEQ ID NO: 4867 - DNA, 20 bp, Artificial
  20-mer unique DNA sequence
ggcggttgggagaaggcgag

SEQ ID NO: 4868 - DNA, 20 bp, Artificial
  20-mer unique DNA sequence
cctacgcccatttacccccc

SEQ ID NO: 4869 - DNA, 20 bp, Artificial
  20-mer unique DNA sequence
tcgtttctctgcggctcccc

SEQ ID NO: 4870 - DNA, 20 bp, Artificial
  20-mer unique DNA sequence
gagtcccccacaagaagccg

SEQ ID NO: 4871 - DNA, 20 bp, Artificial
  20-mer unique DNA sequence
caaacccccgactccaacgc

SEQ ID NO: 4872 - DNA, 20 bp, Artificial
  20-mer unique DNA sequence
agcagctagcccgcgaaaga

SEQ ID NO: 4873 - DNA, 20 bp, Artificial
  20-mer unique DNA sequence
gggcttaattggcgactgtt

SEQ ID NO: 4874 - DNA, 20 bp, Artificial
  20-mer unique DNA sequence
aagagagggcaccgcgcaaa

SEQ ID NO: 4875 - DNA, 20 bp, Artificial
  20-mer unique DNA sequence
ctggtgagcggaaaagcggc

SEQ ID NO: 4876 - DNA, 20 bp, Artificial
  20-mer unique DNA sequence
gtcttctccgccgcgatttc

SEQ ID NO: 4877 - DNA, 20 bp, Artificial
  20-mer unique DNA sequence
tagcgagcctcaacacgcgg

SEQ ID NO: 4878 - DNA, 20 bp, Artificial
  20-mer unique DNA sequence
gttacagcccccgtgccctc

SEQ ID NO: 4879 - DNA, 20 bp, Artificial
  20-mer unique DNA sequence
caagcaaacctacgcgcgaa

SEQ ID NO: 4880 - DNA, 20 bp, Artificial
  20-mer unique DNA sequence
ctcctagaatgtccgcgcgc

SEQ ID NO: 4881 - DNA, 20 bp, Artificial
  20-mer unique DNA sequence
tcttttcggagggcgtggct

SEQ ID NO: 4882 - DNA, 20 bp, Artificial
  20-mer unique DNA sequence
gtggtcagggcgtgtgggct

SEQ ID NO: 4883 - DNA, 20 bp, Artificial
  20-mer unique DNA sequence
cgctaccacccccgcattta

SEQ ID NO: 4884 - DNA, 20 bp, Artificial
  20-mer unique DNA sequence
ttggcaccctggaagcgacg

SEQ ID NO: 4885 - DNA, 20 bp, Artificial
  20-mer unique DNA sequence
gtgcagaggtgtggtcggga

SEQ ID NO: 4886 - DNA, 20 bp, Artificial
  20-mer unique DNA sequence
ctacacccagccacatgccg

SEQ ID NO: 4887 - DNA, 20 bp, Artificial
  20-mer unique DNA sequence
ggccgctcccaatcatgaat

SEQ ID NO: 4888 - DNA, 20 bp, Artificial
  20-mer unique DNA sequence
gcgaagcaagtcgggggttg

SEQ ID NO: 4889 - DNA, 20 bp, Artificial
  20-mer unique DNA sequence
agcccctaggccaaagtgcg

SEQ ID NO: 4890 - DNA, 20 bp, Artificial
  20-mer unique DNA sequence
catcttccgcgtgcttgtgc

SEQ ID NO: 4891 - DNA, 20 bp, Artificial
  20-mer unique DNA sequence
gactggtaagggagcggccg

SEQ ID NO: 4892 - DNA, 20 bp, Artificial
  20-mer unique DNA sequence
ccttgggctgcggtggctta

SEQ ID NO: 4893 - DNA, 20 bp, Artificial
  20-mer unique DNA sequence
cccatcgtgtgccctagcct

SEQ ID NO: 4894 - DNA, 20 bp, Artificial
  20-mer unique DNA sequence
tcccctgcgctctccaaatt

SEQ ID NO: 4895 - DNA, 20 bp, Artificial
  20-mer unique DNA sequence
gggggccgattgatgaaaaa

SEQ ID NO: 4896 - DNA, 20 bp, Artificial
  20-mer unique DNA sequence
ttgggtgagcggatagggca

SEQ ID NO: 4897 - DNA, 20 bp, Artificial
  20-mer unique DNA sequence
gttggggcggattcggagta

SEQ ID NO: 4898 - DNA, 20 bp, Artificial
  20-mer unique DNA sequence
ttaccccattatccgcccca

SEQ ID NO: 4899 - DNA, 20 bp, Artificial
  20-mer unique DNA sequence
aacttccaacatgcgggggg

SEQ ID NO: 4900 - DNA, 20 bp, Artificial
  20-mer unique DNA sequence
accagggaagggcggaaggt

SEQ ID NO: 4901 - DNA, 20 bp, Artificial
  20-mer unique DNA sequence
caccatatcccccaagtccc

SEQ ID NO: 4902 - DNA, 20 bp, Artificial
  20-mer unique DNA sequence
gtggaaatcggctgggaggc

SEQ ID NO: 4903 - DNA, 20 bp, Artificial
  20-mer unique DNA sequence
agcgcccggtagagcacttt

SEQ ID NO: 4904 - DNA, 20 bp, Artificial
  20-mer unique DNA sequence
gggctccgcgcttcatagtc

SEQ ID NO: 4905 - DNA, 20 bp, Artificial
  20-mer unique DNA sequence
atcgaataatggggcggcac

SEQ ID NO: 4906 - DNA, 20 bp, Artificial
  20-mer unique DNA sequence
tcgcggggccttaagcattt

SEQ ID NO: 4907 - DNA, 20 bp, Artificial
  20-mer unique DNA sequence
gtggtccgcgttcggagtat

SEQ ID NO: 4908 - DNA, 20 bp, Artificial
  20-mer unique DNA sequence
tttcctgggcccgtcctgta

SEQ ID NO: 4909 - DNA, 20 bp, Artificial
  20-mer unique DNA sequence
accatccatctcacgggcca

SEQ ID NO: 4910 - DNA, 20 bp, Artificial
  20-mer unique DNA sequence
agaagccctgcgcgataccc

SEQ ID NO: 4911 - DNA, 20 bp, Artificial
  20-mer unique DNA sequence
tgattttaggcccgggatgg

SEQ ID NO: 4912 - DNA, 20 bp, Artificial
  20-mer unique DNA sequence
acctgggatcgcgttgggta

SEQ ID NO: 4913 - DNA, 20 bp, Artificial
  20-mer unique DNA sequence
gttgcgatcgagttccccgg

SEQ ID NO: 4914 - DNA, 20 bp, Artificial
  20-mer unique DNA sequence
ccgcccaatttaaagctgcc

SEQ ID NO: 4915 - DNA, 20 bp, Artificial
  20-mer unique DNA sequence
tcactttgggcggggcttta

SEQ ID NO: 4916 - DNA, 20 bp, Artificial
  20-mer unique DNA sequence
ttggacggtgggacagtgga

SEQ ID NO: 4917 - DNA, 20 bp, Artificial
  20-mer unique DNA sequence
gcaggagtgtcagaggtcgg

SEQ ID NO: 4918 - DNA, 20 bp, Artificial
  20-mer unique DNA sequence
cctaagcaacatccccccga

SEQ ID NO: 4919 - DNA, 20 bp, Artificial
  20-mer unique DNA sequence
aacgttccccatttcgctcc

SEQ ID NO: 4920 - DNA, 20 bp, Artificial
  20-mer unique DNA sequence
ccaattgagaaccgccagcg

SEQ ID NO: 4921 - DNA, 20 bp, Artificial
  20-mer unique DNA sequence
cacgggggggggagactatc

SEQ ID NO: 4922 - DNA, 20 bp, Artificial
  20-mer unique DNA sequence
tcagctcggccacgttcatt

SEQ ID NO: 4923 - DNA, 20 bp, Artificial
  20-mer unique DNA sequence
ccttgccctgtccatctcgc

SEQ ID NO: 4924 - DNA, 20 bp, Artificial
  20-mer unique DNA sequence
tgcccccgatttaccgattc

SEQ ID NO: 4925 - DNA, 20 bp, Artificial
  20-mer unique DNA sequence
gccgtggagcgttatggagg

SEQ ID NO: 4926 - DNA, 20 bp, Artificial
  20-mer unique DNA sequence
ttaggtcagtgtggccggca

SEQ ID NO: 4927 - DNA, 20 bp, Artificial
  20-mer unique DNA sequence
tgacacacccctttttgccg

SEQ ID NO: 4928 - DNA, 20 bp, Artificial
  20-mer unique DNA sequence
gccaactatgcgtcacaggc

SEQ ID NO: 4929 - DNA, 20 bp, Artificial
  20-mer unique DNA sequence
tggcgagtgccgtgcatatc

SEQ ID NO: 4930 - DNA, 20 bp, Artificial
  20-mer unique DNA sequence
ggggctgcaaaaggacgagg

SEQ ID NO: 4931 - DNA, 20 bp, Artificial
  20-mer unique DNA sequence
cataagggcaccgtggggct

SEQ ID NO: 4932 - DNA, 20 bp, Artificial
  20-mer unique DNA sequence
gcgggtgaggagaggtgggt

SEQ ID NO: 4933 - DNA, 20 bp, Artificial
  20-mer unique DNA sequence
tcgtccgcctcagtcttccg

SEQ ID NO: 4934 - DNA, 20 bp, Artificial
  20-mer unique DNA sequence
ctgcccctagttccggtcga

SEQ ID NO: 4935 - DNA, 20 bp, Artificial
  20-mer unique DNA sequence
tgttcccatctcgcgctcgt

SEQ ID NO: 4936 - DNA, 20 bp, Artificial
  20-mer unique DNA sequence
cgccaccccgtcgttctctg

SEQ ID NO: 4937 - DNA, 20 bp, Artificial
  20-mer unique DNA sequence
tgtttaccgttcccccagcc

SEQ ID NO: 4938 - DNA, 20 bp, Artificial
  20-mer unique DNA sequence
attttggggctggctcgggt

SEQ ID NO: 4939 - DNA, 20 bp, Artificial
  20-mer unique DNA sequence
gggtggttcgggactggtgt

SEQ ID NO: 4940 - DNA, 20 bp, Artificial
  20-mer unique DNA sequence
atggattccgcctctgtcgc

SEQ ID NO: 4941 - DNA, 20 bp, Artificial
  20-mer unique DNA sequence
gccagaaaggggcgtacaag

SEQ ID NO: 4942 - DNA, 20 bp, Artificial
  20-mer unique DNA sequence
cacctcggccgctttccata

SEQ ID NO: 4943 - DNA, 20 bp, Artificial
  20-mer unique DNA sequence
ttcgggttggggacagttgc

SEQ ID NO: 4944 - DNA, 20 bp, Artificial
  20-mer unique DNA sequence
accgacgctttgcccgattt

SEQ ID NO: 4945 - DNA, 20 bp, Artificial
  20-mer unique DNA sequence
actcgaaaggccgccggata

SEQ ID NO: 4946 - DNA, 20 bp, Artificial
  20-mer unique DNA sequence
aaatgatgcccccaaccccc

SEQ ID NO: 4947 - DNA, 20 bp, Artificial
  20-mer unique DNA sequence
cccgtcttcgtccatccacc

SEQ ID NO: 4948 - DNA, 20 bp, Artificial
  20-mer unique DNA sequence
tttgagctaccggttcggca

SEQ ID NO: 4949 - DNA, 20 bp, Artificial
  20-mer unique DNA sequence
ccgagtcgcgaacctcacat

SEQ ID NO: 4950 - DNA, 20 bp, Artificial
  20-mer unique DNA sequence
gcgccacgacaaggggacag

SEQ ID NO: 4951 - DNA, 20 bp, Artificial
  20-mer unique DNA sequence
ccaattggccgctgctaccc

SEQ ID NO: 4952 - DNA, 20 bp, Artificial
  20-mer unique DNA sequence
ggaaccgggacataggcaca

SEQ ID NO: 4953 - DNA, 20 bp, Artificial
  20-mer unique DNA sequence
ggctgtcggtcggggctaca

SEQ ID NO: 4954 - DNA, 20 bp, Artificial
  20-mer unique DNA sequence
tgattatgtcgcagggggcc

SEQ ID NO: 4955 - DNA, 20 bp, Artificial
  20-mer unique DNA sequence
agtgtttctggcggacggga

SEQ ID NO: 4956 - DNA, 20 bp, Artificial
  20-mer unique DNA sequence
gtgtccgcgccgtctccatt

SEQ ID NO: 4957 - DNA, 20 bp, Artificial
  20-mer unique DNA sequence
ccgggggcaattggagggta

SEQ ID NO: 4958 - DNA, 20 bp, Artificial
  20-mer unique DNA sequence
caggcgcgcaagagcagatt

SEQ ID NO: 4959 - DNA, 20 bp, Artificial
  20-mer unique DNA sequence
gtcatcacgggccacagggg

SEQ ID NO: 4960 - DNA, 20 bp, Artificial
  20-mer unique DNA sequence
tcgggagcgggtaaagggtg

SEQ ID NO: 4961 - DNA, 20 bp, Artificial
  20-mer unique DNA sequence
tacaaatggggggacgcgac

SEQ ID NO: 4962 - DNA, 20 bp, Artificial
  20-mer unique DNA sequence
gcgaagtagcggaggggacc

SEQ ID NO: 4963 - DNA, 20 bp, Artificial
  20-mer unique DNA sequence
gcctgtctcgggtctgctcg

SEQ ID NO: 4964 - DNA, 20 bp, Artificial
  20-mer unique DNA sequence
ttccgagaagtccgtgacgc

SEQ ID NO: 4965 - DNA, 20 bp, Artificial
  20-mer unique DNA sequence
actgtcgtggtcaggagcgt

SEQ ID NO: 4966 - DNA, 20 bp, Artificial
  20-mer unique DNA sequence
cgcatacgtcccccaacagg

SEQ ID NO: 4967 - DNA, 20 bp, Artificial
  20-mer unique DNA sequence
acccaccccatcgttcaccg

SEQ ID NO: 4968 - DNA, 20 bp, Artificial
  20-mer unique DNA sequence
actaagggcgggggagaacg

SEQ ID NO: 4969 - DNA, 20 bp, Artificial
  20-mer unique DNA sequence
tgagcgcagggtgaatccaa

SEQ ID NO: 4970 - DNA, 20 bp, Artificial
  20-mer unique DNA sequence
caccgacccacattcccccc

SEQ ID NO: 4971 - DNA, 20 bp, Artificial
  20-mer unique DNA sequence
tgaacagtgggcagacgcgt

SEQ ID NO: 4972 - DNA, 20 bp, Artificial
  20-mer unique DNA sequence
ttcacccttcccgactccgt

SEQ ID NO: 4973 - DNA, 20 bp, Artificial
  20-mer unique DNA sequence
tccggggcgcctaatccata

SEQ ID NO: 4974 - DNA, 20 bp, Artificial
  20-mer unique DNA sequence
agtggcaagatgagcggccg

SEQ ID NO: 4975 - DNA, 20 bp, Artificial
  20-mer unique DNA sequence
gcggcgcgacgtattaatga

SEQ ID NO: 4976 - DNA, 20 bp, Artificial
  20-mer unique DNA sequence
agaggaggggaaaagcaccg

SEQ ID NO: 4977 - DNA, 20 bp, Artificial
  20-mer unique DNA sequence
ccatcctgttcgcgcccata

SEQ ID NO: 4978 - DNA, 20 bp, Artificial
  20-mer unique DNA sequence
cggcccccctataaacgtcg

SEQ ID NO: 4979 - DNA, 20 bp, Artificial
  20-mer unique DNA sequence
ccgcctattgtcgcccttgt

SEQ ID NO: 4980 - DNA, 20 bp, Artificial
  20-mer unique DNA sequence
ctcccacacttgccgctacg

SEQ ID NO: 4981 - DNA, 20 bp, Artificial
  20-mer unique DNA sequence
gggactgggctacgaacgga

SEQ ID NO: 4982 - DNA, 20 bp, Artificial
  20-mer unique DNA sequence
gagggagagtaggggcggca

SEQ ID NO: 4983 - DNA, 20 bp, Artificial
  20-mer unique DNA sequence
aacacgctcccccaatccac

SEQ ID NO: 4984 - DNA, 20 bp, Artificial
  20-mer unique DNA sequence
agcggcctatcggctgtgtc

SEQ ID NO: 4985 - DNA, 20 bp, Artificial
  20-mer unique DNA sequence
gccgattggcaggagcgcta

SEQ ID NO: 4986 - DNA, 20 bp, Artificial
  20-mer unique DNA sequence
gaccctcatggaagaccgcc

SEQ ID NO: 4987 - DNA, 20 bp, Artificial
  20-mer unique DNA sequence
ttggccgaaaacagaaccgc

SEQ ID NO: 4988 - DNA, 20 bp, Artificial
  20-mer unique DNA sequence
aggacacgcgatgccaggtt

SEQ ID NO: 4989 - DNA, 20 bp, Artificial
  20-mer unique DNA sequence
cctagtgggcactgcagcaa

SEQ ID NO: 4990 - DNA, 20 bp, Artificial
  20-mer unique DNA sequence
caaggaaaagaccggccatc

SEQ ID NO: 4991 - DNA, 20 bp, Artificial
  20-mer unique DNA sequence
gtcacctacaaccgcgcacg

SEQ ID NO: 4992 - DNA, 20 bp, Artificial
  20-mer unique DNA sequence
gccgccaccacaggaacaag

SEQ ID NO: 4993 - DNA, 20 bp, Artificial
  20-mer unique DNA sequence
ttacctccagccacgtgccg

SEQ ID NO: 4994 - DNA, 20 bp, Artificial
  20-mer unique DNA sequence
tcaccaccgcccatcgagaa

SEQ ID NO: 4995 - DNA, 20 bp, Artificial
  20-mer unique DNA sequence
tgcctaggggtccaatgccg

SEQ ID NO: 4996 - DNA, 20 bp, Artificial
  20-mer unique DNA sequence
agcggggattttggcatgca

SEQ ID NO: 4997 - DNA, 20 bp, Artificial
  20-mer unique DNA sequence
ggccggcacccttaccaaca

SEQ ID NO: 4998 - DNA, 20 bp, Artificial
  20-mer unique DNA sequence
aacccgtccaagccatcatg

SEQ ID NO: 4999 - DNA, 20 bp, Artificial
  20-mer unique DNA sequence
caggacagagctcgaggggg

SEQ ID NO: 5000 - DNA, 20 bp, Artificial
  20-mer unique DNA sequence
tcggggattttggcggtcac

SEQ ID NO: 5001 - DNA, 20 bp, Artificial
  20-mer unique DNA sequence
aagtgggtcatcggggcaac

SEQ ID NO: 5002 - DNA, 20 bp, Artificial
  20-mer unique DNA sequence
atgttgatgtgcggacgggg

SEQ ID NO: 5003 - DNA, 20 bp, Artificial
  20-mer unique DNA sequence
acgagccccgcaaacaactg

SEQ ID NO: 5004 - DNA, 20 bp, Artificial
  20-mer unique DNA sequence
tcggtttcggggcgtcttat

SEQ ID NO: 5005 - DNA, 20 bp, Artificial
  20-mer unique DNA sequence
ggcaaaagcaaggggcgttc

SEQ ID NO: 5006 - DNA, 20 bp, Artificial
  20-mer unique DNA sequence
cgggggtggccatagcaaaa

SEQ ID NO: 5007 - DNA, 20 bp, Artificial
  20-mer unique DNA sequence
tgccggcttcgctccctgta

SEQ ID NO: 5008 - DNA, 20 bp, Artificial
  20-mer unique DNA sequence
ccggtggtgctcgtctgggt

SEQ ID NO: 5009 - DNA, 20 bp, Artificial
  20-mer unique DNA sequence
gtggttgggcggctgtggag

SEQ ID NO: 5010 - DNA, 20 bp, Artificial
  20-mer unique DNA sequence
tctttgtcgggaccgcactg

SEQ ID NO: 5011 - DNA, 20 bp, Artificial
  20-mer unique DNA sequence
atcctcccggccggttacat

SEQ ID NO: 5012 - DNA, 20 bp, Artificial
  20-mer unique DNA sequence
catcgcaaggccgtcaaaag

SEQ ID NO: 5013 - DNA, 20 bp, Artificial
  20-mer unique DNA sequence
agctgcgatcgggaccttcc

SEQ ID NO: 5014 - DNA, 20 bp, Artificial
  20-mer unique DNA sequence
atatgcttcgcgacgcggtc

SEQ ID NO: 5015 - DNA, 20 bp, Artificial
  20-mer unique DNA sequence
tctcagcgtgtgctgacgga

SEQ ID NO: 5016 - DNA, 20 bp, Artificial
  20-mer unique DNA sequence
tcatcttgccatcgctttgc

SEQ ID NO: 5017 - DNA, 20 bp, Artificial
  20-mer unique DNA sequence
cgtcccgcccagtcaaaaca

SEQ ID NO: 5018 - DNA, 20 bp, Artificial
  20-mer unique DNA sequence
accatgacctgagcgagctg

SEQ ID NO: 5019 - DNA, 20 bp, Artificial
  20-mer unique DNA sequence
ctgtcgtcgtcccaagtgtg

SEQ ID NO: 5020 - DNA, 20 bp, Artificial
  20-mer unique DNA sequence
ccgtccgttggtctttgcgt

SEQ ID NO: 5021 - DNA, 20 bp, Artificial
  20-mer unique DNA sequence
gggggctgagttgcgatttg

SEQ ID NO: 5022 - DNA, 20 bp, Artificial
  20-mer unique DNA sequence
tcagaaacaacgcgcgggac

SEQ ID NO: 5023 - DNA, 20 bp, Artificial
  20-mer unique DNA sequence
tcaacaaaagccgcgatccg

SEQ ID NO: 5024 - DNA, 20 bp, Artificial
  20-mer unique DNA sequence
caagccagcccgcgtacgac

SEQ ID NO: 5025 - DNA, 20 bp, Artificial
  20-mer unique DNA sequence
aacagcacaccaccgcgcag

SEQ ID NO: 5026 - DNA, 20 bp, Artificial
  20-mer unique DNA sequence
gacaggctcggcactacctt

SEQ ID NO: 5027 - DNA, 20 bp, Artificial
  20-mer unique DNA sequence
gtcgcaaacaccaccccctt

SEQ ID NO: 5028 - DNA, 20 bp, Artificial
  20-mer unique DNA sequence
cacgccgacccatgctactg

SEQ ID NO: 5029 - DNA, 20 bp, Artificial
  20-mer unique DNA sequence
gattggatgcgggtacggga

SEQ ID NO: 5030 - DNA, 20 bp, Artificial
  20-mer unique DNA sequence
aatatcgcgcgcaccaacca

SEQ ID NO: 5031 - DNA, 20 bp, Artificial
  20-mer unique DNA sequence
agacgcggcccacatagcaa

SEQ ID NO: 5032 - DNA, 20 bp, Artificial
  20-mer unique DNA sequence
gcggcattcggttttaggcg

SEQ ID NO: 5033 - DNA, 20 bp, Artificial
  20-mer unique DNA sequence
tgctttggaccccgtatggc

SEQ ID NO: 5034 - DNA, 20 bp, Artificial
  20-mer unique DNA sequence
gggaggttgacggtgggcat

SEQ ID NO: 5035 - DNA, 20 bp, Artificial
  20-mer unique DNA sequence
acccaatcgcgaacggctag

SEQ ID NO: 5036 - DNA, 20 bp, Artificial
  20-mer unique DNA sequence
tcggccgcaaagtacccaaa

SEQ ID NO: 5037 - DNA, 20 bp, Artificial
  20-mer unique DNA sequence
ttcccggtcacctgcagtca

SEQ ID NO: 5038 - DNA, 20 bp, Artificial
  20-mer unique DNA sequence
tggggctcgtgtccgtttct

SEQ ID NO: 5039 - DNA, 20 bp, Artificial
  20-mer unique DNA sequence
ccacacccaacgctacgcaa

SEQ ID NO: 5040 - DNA, 20 bp, Artificial
  20-mer unique DNA sequence
ccatgttgaggggtcgaggt

SEQ ID NO: 5041 - DNA, 20 bp, Artificial
  20-mer unique DNA sequence
ttgagggttaagcggaggcg

SEQ ID NO: 5042 - DNA, 20 bp, Artificial
  20-mer unique DNA sequence
acctgttcctcgtgcgccct

SEQ ID NO: 5043 - DNA, 20 bp, Artificial
  20-mer unique DNA sequence
gcgagccaaatcatgacggg

SEQ ID NO: 5044 - DNA, 20 bp, Artificial
  20-mer unique DNA sequence
ccccagagcgtgatgcaaca

SEQ ID NO: 5045 - DNA, 20 bp, Artificial
  20-mer unique DNA sequence
actttgggtctggggtgcac

SEQ ID NO: 5046 - DNA, 20 bp, Artificial
  20-mer unique DNA sequence
ggcgggatggttaggggcac

SEQ ID NO: 5047 - DNA, 20 bp, Artificial
  20-mer unique DNA sequence
cgaacctcgctcccgcttcc

SEQ ID NO: 5048 - DNA, 20 bp, Artificial
  20-mer unique DNA sequence
agaatccacggctccccaca

SEQ ID NO: 5049 - DNA, 20 bp, Artificial
  20-mer unique DNA sequence
cctcagactcccgcttgcca

SEQ ID NO: 5050 - DNA, 20 bp, Artificial
  20-mer unique DNA sequence
cagacacgcttccggcagcc

SEQ ID NO: 5051 - DNA, 20 bp, Artificial
  20-mer unique DNA sequence
ctcgacgccgcctcttacgg

SEQ ID NO: 5052 - DNA, 20 bp, Artificial
  20-mer unique DNA sequence
ggggggcgatgaaatggtgt

SEQ ID NO: 5053 - DNA, 20 bp, Artificial
  20-mer unique DNA sequence
agcagcaaacgcacccaaga

SEQ ID NO: 5054 - DNA, 20 bp, Artificial
  20-mer unique DNA sequence
cattccccccgtcagtccat

SEQ ID NO: 5055 - DNA, 20 bp, Artificial
  20-mer unique DNA sequence
tctcttcagtttggcccgca

SEQ ID NO: 5056 - DNA, 20 bp, Artificial
  20-mer unique DNA sequence
actgccgacgagccgataca

SEQ ID NO: 5057 - DNA, 20 bp, Artificial
  20-mer unique DNA sequence
gcggtacccggatttccgtt

SEQ ID NO: 5058 - DNA, 20 bp, Artificial
  20-mer unique DNA sequence
ttgagaggcgcacgggagta

SEQ ID NO: 5059 - DNA, 20 bp, Artificial
  20-mer unique DNA sequence
cttaacgattggaccgcgcg

SEQ ID NO: 5060 - DNA, 20 bp, Artificial
  20-mer unique DNA sequence
tgggggtgagagttgggcga

SEQ ID NO: 5061 - DNA, 20 bp, Artificial
  20-mer unique DNA sequence
ccgcctgccctttgtttcac

SEQ ID NO: 5062 - DNA, 20 bp, Artificial
  20-mer unique DNA sequence
aattcccaccccatccaacg

SEQ ID NO: 5063 - DNA, 20 bp, Artificial
  20-mer unique DNA sequence
gctccctccaacgtccgaac

SEQ ID NO: 5064 - DNA, 20 bp, Artificial
  20-mer unique DNA sequence
ggggggtaggaattgccggg

SEQ ID NO: 5065 - DNA, 20 bp, Artificial
  20-mer unique DNA sequence
cgaagaagatgaccccccgc

SEQ ID NO: 5066 - DNA, 20 bp, Artificial
  20-mer unique DNA sequence
acccgccgaacgctaccctc

SEQ ID NO: 5067 - DNA, 20 bp, Artificial
  20-mer unique DNA sequence
ccccccgcaaattccatacg

SEQ ID NO: 5068 - DNA, 20 bp, Artificial
  20-mer unique DNA sequence
ccccggagaacactgcatca

SEQ ID NO: 5069 - DNA, 20 bp, Artificial
  20-mer unique DNA sequence
ggggccggtgacctagctcg

SEQ ID NO: 5070 - DNA, 20 bp, Artificial
  20-mer unique DNA sequence
gcttgatccggcccacgtta

SEQ ID NO: 5071 - DNA, 20 bp, Artificial
  20-mer unique DNA sequence
gaagcgttgtccggggtctg

SEQ ID NO: 5072 - DNA, 20 bp, Artificial
  20-mer unique DNA sequence
acccctgcccaagtcaaacg

SEQ ID NO: 5073 - DNA, 20 bp, Artificial
  20-mer unique DNA sequence
gtgattcgtcgccgtgcttc

SEQ ID NO: 5074 - DNA, 20 bp, Artificial
  20-mer unique DNA sequence
ttatgtcgggtgggcgaggc

SEQ ID NO: 5075 - DNA, 20 bp, Artificial
  20-mer unique DNA sequence
atggctggggttacgatggg

SEQ ID NO: 5076 - DNA, 20 bp, Artificial
  20-mer unique DNA sequence
aatccacagccccgatgagc

SEQ ID NO: 5077 - DNA, 20 bp, Artificial
  20-mer unique DNA sequence
tggccgatagaaagtcccgc

SEQ ID NO: 5078 - DNA, 20 bp, Artificial
  20-mer unique DNA sequence
gtcgacatgaccgggtgcct

SEQ ID NO: 5079 - DNA, 20 bp, Artificial
  20-mer unique DNA sequence
aatcgtcaaatggtcccggc

SEQ ID NO: 5080 - DNA, 20 bp, Artificial
  20-mer unique DNA sequence
atgatcccggcctttccgac

SEQ ID NO: 5081 - DNA, 20 bp, Artificial
  20-mer unique DNA sequence
tgctcggggtgcgtatcagg

SEQ ID NO: 5082 - DNA, 20 bp, Artificial
  20-mer unique DNA sequence
tagccccattcccaccccga

SEQ ID NO: 5083 - DNA, 20 bp, Artificial
  20-mer unique DNA sequence
tccacatacacctgcggctc

SEQ ID NO: 5084 - DNA, 20 bp, Artificial
  20-mer unique DNA sequence
ctcttgcgttggtcccctgg

SEQ ID NO: 5085 - DNA, 20 bp, Artificial
  20-mer unique DNA sequence
aagcgcggcaaactagggac

SEQ ID NO: 5086 - DNA, 20 bp, Artificial
  20-mer unique DNA sequence
gacccggacgctcaaccatg

SEQ ID NO: 5087 - DNA, 20 bp, Artificial
  20-mer unique DNA sequence
ttgaattcgcgtggtggggc

SEQ ID NO: 5088 - DNA, 20 bp, Artificial
  20-mer unique DNA sequence
gttgcaaatgggccgctgag

SEQ ID NO: 5089 - DNA, 20 bp, Artificial
  20-mer unique DNA sequence
gaccaaggcctcggggaaag

SEQ ID NO: 5090 - DNA, 20 bp, Artificial
  20-mer unique DNA sequence
ctaaccccccgactcaccca

SEQ ID NO: 5091 - DNA, 20 bp, Artificial
  20-mer unique DNA sequence
ctcccaaaagccccaggtcg

SEQ ID NO: 5092 - DNA, 20 bp, Artificial
  20-mer unique DNA sequence
accagcgctccccctttttg

SEQ ID NO: 5093 - DNA, 20 bp, Artificial
  20-mer unique DNA sequence
gtgtgtactggatgcgccgg

SEQ ID NO: 5094 - DNA, 20 bp, Artificial
  20-mer unique DNA sequence
gggggacgaacaagggccaa

SEQ ID NO: 5095 - DNA, 20 bp, Artificial
  20-mer unique DNA sequence
caacaaggcggaggcagcaa

SEQ ID NO: 5096 - DNA, 20 bp, Artificial
  20-mer unique DNA sequence
ttccaagccaatcgatccgg

SEQ ID NO: 5097 - DNA, 20 bp, Artificial
  20-mer unique DNA sequence
gtagtggcgggggagggtgc

SEQ ID NO: 5098 - DNA, 20 bp, Artificial
  20-mer unique DNA sequence
cagcaccccaccgtttaggc

SEQ ID NO: 5099 - DNA, 20 bp, Artificial
  20-mer unique DNA sequence
ttggtgatgaaacggcgcga

SEQ ID NO: 5100 - DNA, 20 bp, Artificial
  20-mer unique DNA sequence
gaagggggggccaatcaggt

SEQ ID NO: 5101 - DNA, 20 bp, Artificial
  20-mer unique DNA sequence
gcgcgaatggggtcgtaatg

SEQ ID NO: 5102 - DNA, 20 bp, Artificial
  20-mer unique DNA sequence
tcgtctgcttttaccccgcc

SEQ ID NO: 5103 - DNA, 20 bp, Artificial
  20-mer unique DNA sequence
gcatgggcaacacccgtacg

SEQ ID NO: 5104 - DNA, 20 bp, Artificial
  20-mer unique DNA sequence
aaagcattcagcagcgggcg

SEQ ID NO: 5105 - DNA, 20 bp, Artificial
  20-mer unique DNA sequence
ccctgtcccctgtttctgcg

SEQ ID NO: 5106 - DNA, 20 bp, Artificial
  20-mer unique DNA sequence
gtccgggcctgtttttgggt

SEQ ID NO: 5107 - DNA, 20 bp, Artificial
  20-mer unique DNA sequence
ctatttttggcaccggcgcc

SEQ ID NO: 5108 - DNA, 20 bp, Artificial
  20-mer unique DNA sequence
accttcgcgggcgttttctt

SEQ ID NO: 5109 - DNA, 20 bp, Artificial
  20-mer unique DNA sequence
ttgccgcgccctaaaatgca

SEQ ID NO: 5110 - DNA, 20 bp, Artificial
  20-mer unique DNA sequence
ctcactccagccgcaatcgc

SEQ ID NO: 5111 - DNA, 20 bp, Artificial
  20-mer unique DNA sequence
tcgggcgcatttggaacaga

SEQ ID NO: 5112 - DNA, 20 bp, Artificial
  20-mer unique DNA sequence
ggcataccccctccgcctag

SEQ ID NO: 5113 - DNA, 20 bp, Artificial
  20-mer unique DNA sequence
tcgatggtcggctgaggtgg

SEQ ID NO: 5114 - DNA, 20 bp, Artificial
  20-mer unique DNA sequence
cccattcgaaaaacagcccg

SEQ ID NO: 5115 - DNA, 20 bp, Artificial
  20-mer unique DNA sequence
cgtccgccataaagccacaa

SEQ ID NO: 5116 - DNA, 20 bp, Artificial
  20-mer unique DNA sequence
tacgcggccacgtgcgtaaa

SEQ ID NO: 5117 - DNA, 20 bp, Artificial
  20-mer unique DNA sequence
aacatgtacgggccgtggct

SEQ ID NO: 5118 - DNA, 20 bp, Artificial
  20-mer unique DNA sequence
acatcccgcctacgtttgcg

SEQ ID NO: 5119 - DNA, 20 bp, Artificial
  20-mer unique DNA sequence
gtcggcgattggcggatttt

SEQ ID NO: 5120 - DNA, 20 bp, Artificial
  20-mer unique DNA sequence
tgcgtggggaggcctgtact

SEQ ID NO: 5121 - DNA, 20 bp, Artificial
  20-mer unique DNA sequence
ggacaccacggcactcgagc

SEQ ID NO: 5122 - DNA, 20 bp, Artificial
  20-mer unique DNA sequence
cagcccacatatcgcggaaa

SEQ ID NO: 5123 - DNA, 20 bp, Artificial
  20-mer unique DNA sequence
gcataagccgacaatcccca

SEQ ID NO: 5124 - DNA, 20 bp, Artificial
  20-mer unique DNA sequence
cccgccgcaaatcaaagact

SEQ ID NO: 5125 - DNA, 20 bp, Artificial
  20-mer unique DNA sequence
accaaaaccgcaacgcaacg

SEQ ID NO: 5126 - DNA, 20 bp, Artificial
  20-mer unique DNA sequence
tcccgccttagggttgccac

SEQ ID NO: 5127 - DNA, 20 bp, Artificial
  20-mer unique DNA sequence
cttgaccgacgctccgccta

SEQ ID NO: 5128 - DNA, 20 bp, Artificial
  20-mer unique DNA sequence
catgtcggcgcaacttggaa

SEQ ID NO: 5129 - DNA, 20 bp, Artificial
  20-mer unique DNA sequence
aaaacatgtcgcactcgccg

SEQ ID NO: 5130 - DNA, 20 bp, Artificial
  20-mer unique DNA sequence
ttatgacggcggaagggcag

SEQ ID NO: 5131 - DNA, 20 bp, Artificial
  20-mer unique DNA sequence
cgccaccaccgacacaaatg

SEQ ID NO: 5132 - DNA, 20 bp, Artificial
  20-mer unique DNA sequence
caggacgggccaaagaaggg

SEQ ID NO: 5133 - DNA, 20 bp, Artificial
  20-mer unique DNA sequence
caaaatctctatgcgccgcg

SEQ ID NO: 5134 - DNA, 20 bp, Artificial
  20-mer unique DNA sequence
agagcccctacccccgctac

SEQ ID NO: 5135 - DNA, 20 bp, Artificial
  20-mer unique DNA sequence
gcgtgagggatgtggtcgga

SEQ ID NO: 5136 - DNA, 20 bp, Artificial
  20-mer unique DNA sequence
ttggtgtgcgccggaattga

SEQ ID NO: 5137 - DNA, 20 bp, Artificial
  20-mer unique DNA sequence
aaaaggcttgtcaggggtgc

SEQ ID NO: 5138 - DNA, 20 bp, Artificial
  20-mer unique DNA sequence
ggagggtgccgtggtggttc

SEQ ID NO: 5139 - DNA, 20 bp, Artificial
  20-mer unique DNA sequence
ctggagtcgacgtgccatga

SEQ ID NO: 5140 - DNA, 20 bp, Artificial
  20-mer unique DNA sequence
ccctgcgtctctccccctgc

SEQ ID NO: 5141 - DNA, 20 bp, Artificial
  20-mer unique DNA sequence
tcgaatcccaaacccgctgt

SEQ ID NO: 5142 - DNA, 20 bp, Artificial
  20-mer unique DNA sequence
actcgcctgagtgcgctaac

SEQ ID NO: 5143 - DNA, 20 bp, Artificial
  20-mer unique DNA sequence
ttcaattgtgtggcccctgc

SEQ ID NO: 5144 - DNA, 20 bp, Artificial
  20-mer unique DNA sequence
ttttgacgggggggcttttg

SEQ ID NO: 5145 - DNA, 20 bp, Artificial
  20-mer unique DNA sequence
tcggtcatctggctggaggg

SEQ ID NO: 5146 - DNA, 20 bp, Artificial
  20-mer unique DNA sequence
cggcgctgggtgtacgatgg

SEQ ID NO: 5147 - DNA, 20 bp, Artificial
  20-mer unique DNA sequence
tggagaagagggcgcgaaga

SEQ ID NO: 5148 - DNA, 20 bp, Artificial
  20-mer unique DNA sequence
ggtaggcgaggatggaggtt

SEQ ID NO: 5149 - DNA, 20 bp, Artificial
  20-mer unique DNA sequence
atgtccccccgtcccaaaaa

SEQ ID NO: 5150 - DNA, 20 bp, Artificial
  20-mer unique DNA sequence
ctcatcacgccctccgccta

SEQ ID NO: 5151 - DNA, 20 bp, Artificial
  20-mer unique DNA sequence
tcttccttgccgccctgctt

SEQ ID NO: 5152 - DNA, 20 bp, Artificial
  20-mer unique DNA sequence
tagtgcaaaaaatcgcggcg

SEQ ID NO: 5153 - DNA, 20 bp, Artificial
  20-mer unique DNA sequence
aatcgtcacagcgtgggcaa

SEQ ID NO: 5154 - DNA, 20 bp, Artificial
  20-mer unique DNA sequence
gcgttcttaggccccggtgt

SEQ ID NO: 5155 - DNA, 20 bp, Artificial
  20-mer unique DNA sequence
tcgatttttcccggcccatg

SEQ ID NO: 5156 - DNA, 20 bp, Artificial
  20-mer unique DNA sequence
accgcaccagcattcacaca

SEQ ID NO: 5157 - DNA, 20 bp, Artificial
  20-mer unique DNA sequence
gcctcggtcgaacatgccaa

SEQ ID NO: 5158 - DNA, 20 bp, Artificial
  20-mer unique DNA sequence
attgcgggaggggaggctta

SEQ ID NO: 5159 - DNA, 20 bp, Artificial
  20-mer unique DNA sequence
tcgtcccgctcaaatgccac

SEQ ID NO: 5160 - DNA, 20 bp, Artificial
  20-mer unique DNA sequence
tcgcggactatagcgctcgt

SEQ ID NO: 5161 - DNA, 20 bp, Artificial
  20-mer unique DNA sequence
atcggcccggatagcgtaac

SEQ ID NO: 5162 - DNA, 20 bp, Artificial
  20-mer unique DNA sequence
acggacgtcacgttaggcat

SEQ ID NO: 5163 - DNA, 20 bp, Artificial
  20-mer unique DNA sequence
caacgtctcacgctgcatgg

SEQ ID NO: 5164 - DNA, 20 bp, Artificial
  20-mer unique DNA sequence
gcgagctgggacggttggtt

SEQ ID NO: 5165 - DNA, 20 bp, Artificial
  20-mer unique DNA sequence
acgcaagagaacgggacgcc

SEQ ID NO: 5166 - DNA, 20 bp, Artificial
  20-mer unique DNA sequence
ggctttgaggtgctttggcg

SEQ ID NO: 5167 - DNA, 20 bp, Artificial
  20-mer unique DNA sequence
tggctttacgacggctggag

SEQ ID NO: 5168 - DNA, 20 bp, Artificial
  20-mer unique DNA sequence
tgtgacgcaaaatccggacg

SEQ ID NO: 5169 - DNA, 20 bp, Artificial
  20-mer unique DNA sequence
agggggtgtggggctgtcat

SEQ ID NO: 5170 - DNA, 20 bp, Artificial
  20-mer unique DNA sequence
tgccctgattacccaacccg

SEQ ID NO: 5171 - DNA, 20 bp, Artificial
  20-mer unique DNA sequence
cccgctgtccgttttcttgg

SEQ ID NO: 5172 - DNA, 20 bp, Artificial
  20-mer unique DNA sequence
ccgggggcaaggagaccaac

SEQ ID NO: 5173 - DNA, 20 bp, Artificial
  20-mer unique DNA sequence
aagaaccctgcaaagcccgc

SEQ ID NO: 5174 - DNA, 20 bp, Artificial
  20-mer unique DNA sequence
cggtgtcataatcggggcgt

SEQ ID NO: 5175 - DNA, 20 bp, Artificial
  20-mer unique DNA sequence
tccactgtaccgcgtccccg

SEQ ID NO: 5176 - DNA, 20 bp, Artificial
  20-mer unique DNA sequence
ggtcggccgtgattgaggtg

SEQ ID NO: 5177 - DNA, 20 bp, Artificial
  20-mer unique DNA sequence
ggcctcttcccccttgttgc

SEQ ID NO: 5178 - DNA, 20 bp, Artificial
  20-mer unique DNA sequence
acgagtagggcgccagcaat

SEQ ID NO: 5179 - DNA, 20 bp, Artificial
  20-mer unique DNA sequence
gacgtgtatgggcgagccga

SEQ ID NO: 5180 - DNA, 20 bp, Artificial
  20-mer unique DNA sequence
ttctcccattgctgtgcccc

SEQ ID NO: 5181 - DNA, 20 bp, Artificial
  20-mer unique DNA sequence
tctgggcggagatgcaattg

SEQ ID NO: 5182 - DNA, 20 bp, Artificial
  20-mer unique DNA sequence
tgaggacgggcaggagcgag

SEQ ID NO: 5183 - DNA, 20 bp, Artificial
  20-mer unique DNA sequence
gggccgggtatactgggtca

SEQ ID NO: 5184 - DNA, 20 bp, Artificial
  20-mer unique DNA sequence
cacgacgcagccaaagaacc

SEQ ID NO: 5185 - DNA, 20 bp, Artificial
  20-mer unique DNA sequence
tccgagggcgaattccgtac

SEQ ID NO: 5186 - DNA, 20 bp, Artificial
  20-mer unique DNA sequence
ggaagtgggccgtcagcaac

SEQ ID NO: 5187 - DNA, 20 bp, Artificial
  20-mer unique DNA sequence
cgccgaaagccacgtatgcc

SEQ ID NO: 5188 - DNA, 20 bp, Artificial
  20-mer unique DNA sequence
agggcgatgtcctgcggttc

SEQ ID NO: 5189 - DNA, 20 bp, Artificial
  20-mer unique DNA sequence
tgctggccgggttgtaggtg

SEQ ID NO: 5190 - DNA, 20 bp, Artificial
  20-mer unique DNA sequence
acttccggctacaccaggga

SEQ ID NO: 5191 - DNA, 20 bp, Artificial
  20-mer unique DNA sequence
ttcctcggtcactcggcaca

SEQ ID NO: 5192 - DNA, 20 bp, Artificial
  20-mer unique DNA sequence
gaaggcccgggagatgcata

SEQ ID NO: 5193 - DNA, 20 bp, Artificial
  20-mer unique DNA sequence
tcttttccggtcgtcaggcg

SEQ ID NO: 5194 - DNA, 20 bp, Artificial
  20-mer unique DNA sequence
tgccaatcccttccccagcg

SEQ ID NO: 5195 - DNA, 20 bp, Artificial
  20-mer unique DNA sequence
tgctggtaatcgaaacgcgg

SEQ ID NO: 5196 - DNA, 20 bp, Artificial
  20-mer unique DNA sequence
gaatcggctaaacggtcggg

SEQ ID NO: 5197 - DNA, 20 bp, Artificial
  20-mer unique DNA sequence
tcgctacccaccctttgcca

SEQ ID NO: 5198 - DNA, 20 bp, Artificial
  20-mer unique DNA sequence
gttgcggcgttgcgtagttc

SEQ ID NO: 5199 - DNA, 20 bp, Artificial
  20-mer unique DNA sequence
ttgaaaactccgcccatccc

SEQ ID NO: 5200 - DNA, 20 bp, Artificial
  20-mer unique DNA sequence
cccgagcgcgcctatgatga

SEQ ID NO: 5201 - DNA, 20 bp, Artificial
  20-mer unique DNA sequence
acttggccgcgtctgtctcg

SEQ ID NO: 5202 - DNA, 20 bp, Artificial
  20-mer unique DNA sequence
agcttcgatggcggtggttg

SEQ ID NO: 5203 - DNA, 20 bp, Artificial
  20-mer unique DNA sequence
cgcctcaacaattcaccgca

SEQ ID NO: 5204 - DNA, 20 bp, Artificial
  20-mer unique DNA sequence
ggggcaggcgcatggaatac

SEQ ID NO: 5205 - DNA, 20 bp, Artificial
  20-mer unique DNA sequence
gcggcaaggcagtacgtcaa

SEQ ID NO: 5206 - DNA, 20 bp, Artificial
  20-mer unique DNA sequence
aagaccacacccccgagcaa

SEQ ID NO: 5207 - DNA, 20 bp, Artificial
  20-mer unique DNA sequence
acggaaagcgggcaaagaca

SEQ ID NO: 5208 - DNA, 20 bp, Artificial
  20-mer unique DNA sequence
tagcagcaggtaggcggggg

SEQ ID NO: 5209 - DNA, 20 bp, Artificial
  20-mer unique DNA sequence
actgatgcgtggtggttgcg

SEQ ID NO: 5210 - DNA, 20 bp, Artificial
  20-mer unique DNA sequence
tttgcgacgtgcgtaccgtt

SEQ ID NO: 5211 - DNA, 20 bp, Artificial
  20-mer unique DNA sequence
cagtgagggaccgagccgtt

SEQ ID NO: 5212 - DNA, 20 bp, Artificial
  20-mer unique DNA sequence
cggcgccatcagaacccatt

SEQ ID NO: 5213 - DNA, 20 bp, Artificial
  20-mer unique DNA sequence
cctttaacccacgcgcccag

SEQ ID NO: 5214 - DNA, 20 bp, Artificial
  20-mer unique DNA sequence
cggacctatccgagccacaa

SEQ ID NO: 5215 - DNA, 20 bp, Artificial
  20-mer unique DNA sequence
aaactcacgtggtcgccagc

SEQ ID NO: 5216 - DNA, 20 bp, Artificial
  20-mer unique DNA sequence
cctttctgctttggcgcccc

SEQ ID NO: 5217 - DNA, 20 bp, Artificial
  20-mer unique DNA sequence
tcttggaggccggatgctgt

SEQ ID NO: 5218 - DNA, 20 bp, Artificial
  20-mer unique DNA sequence
gggtgcgctttgctatttgc

SEQ ID NO: 5219 - DNA, 20 bp, Artificial
  20-mer unique DNA sequence
gcctccaagctactcccggg

SEQ ID NO: 5220 - DNA, 20 bp, Artificial
  20-mer unique DNA sequence
tttgggaagcgttggcagga

SEQ ID NO: 5221 - DNA, 20 bp, Artificial
  20-mer unique DNA sequence
gcagcggaggtcaaagaggc

SEQ ID NO: 5222 - DNA, 20 bp, Artificial
  20-mer unique DNA sequence
agcgagaacgaataggcggg

SEQ ID NO: 5223 - DNA, 20 bp, Artificial
  20-mer unique DNA sequence
gatatgcagagcggaggccc

SEQ ID NO: 5224 - DNA, 20 bp, Artificial
  20-mer unique DNA sequence
cgattgttttggccggctcc

SEQ ID NO: 5225 - DNA, 20 bp, Artificial
  20-mer unique DNA sequence
cagcgggaagcgagtggact

SEQ ID NO: 5226 - DNA, 20 bp, Artificial
  20-mer unique DNA sequence
cctcgggcggaagaattgaa

SEQ ID NO: 5227 - DNA, 20 bp, Artificial
  20-mer unique DNA sequence
ggtctttttgccattccgcg

SEQ ID NO: 5228 - DNA, 20 bp, Artificial
  20-mer unique DNA sequence
gttgcatgtgctgtcgggca

SEQ ID NO: 5229 - DNA, 20 bp, Artificial
  20-mer unique DNA sequence
tggtggtcaggccgcagtaa

SEQ ID NO: 5230 - DNA, 20 bp, Artificial
  20-mer unique DNA sequence
agccgccactagtccacgca

SEQ ID NO: 5231 - DNA, 20 bp, Artificial
  20-mer unique DNA sequence
tcggggcaggacatgtggag

SEQ ID NO: 5232 - DNA, 20 bp, Artificial
  20-mer unique DNA sequence
cccgacccacaacacgacaa

SEQ ID NO: 5233 - DNA, 20 bp, Artificial
  20-mer unique DNA sequence
gaagccagcaaagcagccgt

SEQ ID NO: 5234 - DNA, 20 bp, Artificial
  20-mer unique DNA sequence
ggcgtgtttgaggggttcga

SEQ ID NO: 5235 - DNA, 20 bp, Artificial
  20-mer unique DNA sequence
tgctgcccccgaatccttgt

SEQ ID NO: 5236 - DNA, 20 bp, Artificial
  20-mer unique DNA sequence
agctgtttcgcccgcatctc

SEQ ID NO: 5237 - DNA, 20 bp, Artificial
  20-mer unique DNA sequence
gggggccatgacggtacggt

SEQ ID NO: 5238 - DNA, 20 bp, Artificial
  20-mer unique DNA sequence
cgcccttcgcgggttcattt

SEQ ID NO: 5239 - DNA, 20 bp, Artificial
  20-mer unique DNA sequence
ctcgggcctcacaaattgcc

SEQ ID NO: 5240 - DNA, 20 bp, Artificial
  20-mer unique DNA sequence
tcgatgagagggagcgtgga

SEQ ID NO: 5241 - DNA, 20 bp, Artificial
  20-mer unique DNA sequence
catgtcccaaccgcccctta

SEQ ID NO: 5242 - DNA, 20 bp, Artificial
  20-mer unique DNA sequence
ttcactataccggcagcagc

SEQ ID NO: 5243 - DNA, 20 bp, Artificial
  20-mer unique DNA sequence
ccagggcgaaacgatgacgg

SEQ ID NO: 5244 - DNA, 20 bp, Artificial
  20-mer unique DNA sequence
agtgtagagtggccccttcg

SEQ ID NO: 5245 - DNA, 20 bp, Artificial
  20-mer unique DNA sequence
gcgactgtcatgtggcagga

SEQ ID NO: 5246 - DNA, 20 bp, Artificial
  20-mer unique DNA sequence
gcgcccgacccttaagaacc

SEQ ID NO: 5247 - DNA, 20 bp, Artificial
  20-mer unique DNA sequence
gtgtgctgagtggcgggtcg

SEQ ID NO: 5248 - DNA, 20 bp, Artificial
  20-mer unique DNA sequence
agcccaccgcgtccctattt

SEQ ID NO: 5249 - DNA, 20 bp, Artificial
  20-mer unique DNA sequence
tgagcgcggtgtaactgggg

SEQ ID NO: 5250 - DNA, 20 bp, Artificial
  20-mer unique DNA sequence
gatggggaacgagggaggcg

SEQ ID NO: 5251 - DNA, 20 bp, Artificial
  20-mer unique DNA sequence
acgccaccttctctcaccgc

SEQ ID NO: 5252 - DNA, 20 bp, Artificial
  20-mer unique DNA sequence
gcaacagggggagccaagaa

SEQ ID NO: 5253 - DNA, 20 bp, Artificial
  20-mer unique DNA sequence
gtctggcgggcttgctttgc

SEQ ID NO: 5254 - DNA, 20 bp, Artificial
  20-mer unique DNA sequence
ccacaaagatgcagcccgaa

SEQ ID NO: 5255 - DNA, 20 bp, Artificial
  20-mer unique DNA sequence
tgtcggtgcgtattggggga

SEQ ID NO: 5256 - DNA, 20 bp, Artificial
  20-mer unique DNA sequence
ccctcgccacctgcttcatt

SEQ ID NO: 5257 - DNA, 20 bp, Artificial
  20-mer unique DNA sequence
tggtttgtgagcattcggcc

SEQ ID NO: 5258 - DNA, 20 bp, Artificial
  20-mer unique DNA sequence
tgcgggcagaagttatgggg

SEQ ID NO: 5259 - DNA, 20 bp, Artificial
  20-mer unique DNA sequence
ggggctaattcgtcacgggg

SEQ ID NO: 5260 - DNA, 20 bp, Artificial
  20-mer unique DNA sequence
actgagccggtcgcaacata

SEQ ID NO: 5261 - DNA, 20 bp, Artificial
  20-mer unique DNA sequence
cccgggaaccaaagcaccta

SEQ ID NO: 5262 - DNA, 20 bp, Artificial
  20-mer unique DNA sequence
accccatggtacgcagacct

SEQ ID NO: 5263 - DNA, 20 bp, Artificial
  20-mer unique DNA sequence
ggtaactacgggcgctgaga

SEQ ID NO: 5264 - DNA, 20 bp, Artificial
  20-mer unique DNA sequence
accgaacacgggggagaggt

SEQ ID NO: 5265 - DNA, 20 bp, Artificial
  20-mer unique DNA sequence
ctcgcccgtgatggaattcg

SEQ ID NO: 5266 - DNA, 20 bp, Artificial
  20-mer unique DNA sequence
tgttggcggtgttgtgcagg

SEQ ID NO: 5267 - DNA, 20 bp, Artificial
  20-mer unique DNA sequence
tacacgccaccgaccccatc

SEQ ID NO: 5268 - DNA, 20 bp, Artificial
  20-mer unique DNA sequence
tcagcgaggaccggcatcaa

SEQ ID NO: 5269 - DNA, 20 bp, Artificial
  20-mer unique DNA sequence
acacggtgaccagcgaagac

SEQ ID NO: 5270 - DNA, 20 bp, Artificial
  20-mer unique DNA sequence
agcaggcagtcagcgcagtc

SEQ ID NO: 5271 - DNA, 20 bp, Artificial
  20-mer unique DNA sequence
cgtcgggcttcttactggtg

SEQ ID NO: 5272 - DNA, 20 bp, Artificial
  20-mer unique DNA sequence
aggtgggaaatcggggcgag

SEQ ID NO: 5273 - DNA, 20 bp, Artificial
  20-mer unique DNA sequence
ggggcaaaggagtgaggggg

SEQ ID NO: 5274 - DNA, 20 bp, Artificial
  20-mer unique DNA sequence
ggcgtgagcgtcgtgatgaa

SEQ ID NO: 5275 - DNA, 20 bp, Artificial
  20-mer unique DNA sequence
tcccagccatttcccgcttc

SEQ ID NO: 5276 - DNA, 20 bp, Artificial
  20-mer unique DNA sequence
ttgaggtcccgagaggtgct

SEQ ID NO: 5277 - DNA, 20 bp, Artificial
  20-mer unique DNA sequence
tgaccggcgttagtcgctca

SEQ ID NO: 5278 - DNA, 20 bp, Artificial
  20-mer unique DNA sequence
ctagcttgccccccccgaaa

SEQ ID NO: 5279 - DNA, 20 bp, Artificial
  20-mer unique DNA sequence
gactgatcgtgcccagggat

SEQ ID NO: 5280 - DNA, 20 bp, Artificial
  20-mer unique DNA sequence
ccaaccacaggcacccaagc

SEQ ID NO: 5281 - DNA, 20 bp, Artificial
  20-mer unique DNA sequence
gcttcgctcctcacctccgg

SEQ ID NO: 5282 - DNA, 20 bp, Artificial
  20-mer unique DNA sequence
ggctgcggcttgggagtaca

SEQ ID NO: 5283 - DNA, 20 bp, Artificial
  20-mer unique DNA sequence
accgccgtccacctcatcga

SEQ ID NO: 5284 - DNA, 20 bp, Artificial
  20-mer unique DNA sequence
aagggggcgcatattctgag

SEQ ID NO: 5285 - DNA, 20 bp, Artificial
  20-mer unique DNA sequence
ggccaacaaccgtccgctat

SEQ ID NO: 5286 - DNA, 20 bp, Artificial
  20-mer unique DNA sequence
agcgggcgttggaaaataca

SEQ ID NO: 5287 - DNA, 20 bp, Artificial
  20-mer unique DNA sequence
taaaccccccgccacgagta

SEQ ID NO: 5288 - DNA, 20 bp, Artificial
  20-mer unique DNA sequence
acccattaactccccgccgt

SEQ ID NO: 5289 - DNA, 20 bp, Artificial
  20-mer unique DNA sequence
agcgtgtgaggggtgcgtgg

SEQ ID NO: 5290 - DNA, 20 bp, Artificial
  20-mer unique DNA sequence
tcacgcatcccctgccactc

SEQ ID NO: 5291 - DNA, 20 bp, Artificial
  20-mer unique DNA sequence
aaggattgaaacgggtggcg

SEQ ID NO: 5292 - DNA, 20 bp, Artificial
  20-mer unique DNA sequence
accgccatgcccttccgtag

SEQ ID NO: 5293 - DNA, 20 bp, Artificial
  20-mer unique DNA sequence
cgctgctcccgttgttctca

SEQ ID NO: 5294 - DNA, 20 bp, Artificial
  20-mer unique DNA sequence
cttcacccaccgccctgttt

SEQ ID NO: 5295 - DNA, 20 bp, Artificial
  20-mer unique DNA sequence
aaggtcgccgtctcaacgat

SEQ ID NO: 5296 - DNA, 20 bp, Artificial
  20-mer unique DNA sequence
gacagcggcacacaacgggt

SEQ ID NO: 5297 - DNA, 20 bp, Artificial
  20-mer unique DNA sequence
tgatgtgccccgtggtttgg

SEQ ID NO: 5298 - DNA, 20 bp, Artificial
  20-mer unique DNA sequence
gcgccacaaccaccttgcac

SEQ ID NO: 5299 - DNA, 20 bp, Artificial
  20-mer unique DNA sequence
gatccagtcgcacgcaaagc

SEQ ID NO: 5300 - DNA, 20 bp, Artificial
  20-mer unique DNA sequence
tggtggagattgaggccggc

SEQ ID NO: 5301 - DNA, 20 bp, Artificial
  20-mer unique DNA sequence
gtaggcaggcatgggcaggt

SEQ ID NO: 5302 - DNA, 20 bp, Artificial
  20-mer unique DNA sequence
tggatgggcggagagtcggt

SEQ ID NO: 5303 - DNA, 20 bp, Artificial
  20-mer unique DNA sequence
gaacaccgcccctgcaaatt

SEQ ID NO: 5304 - DNA, 20 bp, Artificial
  20-mer unique DNA sequence
ctcgcaccccatcacccagc

SEQ ID NO: 5305 - DNA, 20 bp, Artificial
  20-mer unique DNA sequence
aggggagggagcggcggtat

SEQ ID NO: 5306 - DNA, 20 bp, Artificial
  20-mer unique DNA sequence
gtagacatcgcgccccaacg

SEQ ID NO: 5307 - DNA, 20 bp, Artificial
  20-mer unique DNA sequence
gacggataggcaaacccccc

SEQ ID NO: 5308 - DNA, 20 bp, Artificial
  20-mer unique DNA sequence
gtggggctccggtttcaaga

SEQ ID NO: 5309 - DNA, 20 bp, Artificial
  20-mer unique DNA sequence
agcagaacagcggggaacgt

SEQ ID NO: 5310 - DNA, 20 bp, Artificial
  20-mer unique DNA sequence
tcggcctcatgtcgcttttt

SEQ ID NO: 5311 - DNA, 20 bp, Artificial
  20-mer unique DNA sequence
ggctcttcgctgcactccgg

SEQ ID NO: 5312 - DNA, 20 bp, Artificial
  20-mer unique DNA sequence
cgccctgtgcagacgctaac

SEQ ID NO: 5313 - DNA, 20 bp, Artificial
  20-mer unique DNA sequence
catgcgagcaggggtcaaga

SEQ ID NO: 5314 - DNA, 20 bp, Artificial
  20-mer unique DNA sequence
ttgggcattgtttggagcgg

SEQ ID NO: 5315 - DNA, 20 bp, Artificial
  20-mer unique DNA sequence
attgcgcatggacgtagggg

SEQ ID NO: 5316 - DNA, 20 bp, Artificial
  20-mer unique DNA sequence
ggggttcgctcgcggtgtac

SEQ ID NO: 5317 - DNA, 20 bp, Artificial
  20-mer unique DNA sequence
ggtgcgggttgggaatggtc

SEQ ID NO: 5318 - DNA, 20 bp, Artificial
  20-mer unique DNA sequence
cgccgaccttcctacccacg

SEQ ID NO: 5319 - DNA, 20 bp, Artificial
  20-mer unique DNA sequence
tgcgggagatggggtcagag

SEQ ID NO: 5320 - DNA, 20 bp, Artificial
  20-mer unique DNA sequence
cctcgttctcccaaggcccg

SEQ ID NO: 5321 - DNA, 20 bp, Artificial
  20-mer unique DNA sequence
ctaaagtcggctctcgcgcg

SEQ ID NO: 5322 - DNA, 20 bp, Artificial
  20-mer unique DNA sequence
gcgagcaacaaggcgaccaa

SEQ ID NO: 5323 - DNA, 20 bp, Artificial
  20-mer unique DNA sequence
tgaacgtcgatagcgggcgg

SEQ ID NO: 5324 - DNA, 20 bp, Artificial
  20-mer unique DNA sequence
agaaacacccgcgccacctc

SEQ ID NO: 5325 - DNA, 20 bp, Artificial
  20-mer unique DNA sequence
cagggtagcgaggagagcgg

SEQ ID NO: 5326 - DNA, 20 bp, Artificial
  20-mer unique DNA sequence
gcccctccggtcccaagtac

SEQ ID NO: 5327 - DNA, 20 bp, Artificial
  20-mer unique DNA sequence
ccaccacaattttccgccct

SEQ ID NO: 5328 - DNA, 20 bp, Artificial
  20-mer unique DNA sequence
tgaggtctatggcggggcag

SEQ ID NO: 5329 - DNA, 20 bp, Artificial
  20-mer unique DNA sequence
tactcctccctcacccccga

SEQ ID NO: 5330 - DNA, 20 bp, Artificial
  20-mer unique DNA sequence
tccacccagtctcccgccct

SEQ ID NO: 5331 - DNA, 20 bp, Artificial
  20-mer unique DNA sequence
tacccgcccacgcgacatta

SEQ ID NO: 5332 - DNA, 20 bp, Artificial
  20-mer unique DNA sequence
attcgttgagcttcgccggg

SEQ ID NO: 5333 - DNA, 20 bp, Artificial
  20-mer unique DNA sequence
tagggccggagtcgtcaaag

SEQ ID NO: 5334 - DNA, 20 bp, Artificial
  20-mer unique DNA sequence
atagttgcggggacctcgga

SEQ ID NO: 5335 - DNA, 20 bp, Artificial
  20-mer unique DNA sequence
atcgttgtcttcccggcctc

SEQ ID NO: 5336 - DNA, 20 bp, Artificial
  20-mer unique DNA sequence
ttgcatttcccccctggtga

SEQ ID NO: 5337 - DNA, 20 bp, Artificial
  20-mer unique DNA sequence
gttgcgcgacttgatgagcc

SEQ ID NO: 5338 - DNA, 20 bp, Artificial
  20-mer unique DNA sequence
aagcgtccgtcccctggtta

SEQ ID NO: 5339 - DNA, 20 bp, Artificial
  20-mer unique DNA sequence
aactcatcccctccccccac

SEQ ID NO: 5340 - DNA, 20 bp, Artificial
  20-mer unique DNA sequence
aggggagcagccgaggttta

SEQ ID NO: 5341 - DNA, 20 bp, Artificial
  20-mer unique DNA sequence
cggttgcgcggttaatgaaa

SEQ ID NO: 5342 - DNA, 20 bp, Artificial
  20-mer unique DNA sequence
cgggtggctatttctggcgc

SEQ ID NO: 5343 - DNA, 20 bp, Artificial
  20-mer unique DNA sequence
ttccgacgctaatggccccc

SEQ ID NO: 5344 - DNA, 20 bp, Artificial
  20-mer unique DNA sequence
aggcgtcttccgttcgtgca

SEQ ID NO: 5345 - DNA, 20 bp, Artificial
  20-mer unique DNA sequence
gctttaatcgctgccgcctc

SEQ ID NO: 5346 - DNA, 20 bp, Artificial
  20-mer unique DNA sequence
gtgagggataacgcgccgaa

SEQ ID NO: 5347 - DNA, 20 bp, Artificial
  20-mer unique DNA sequence
gaaatttgcttcgcgggcct

SEQ ID NO: 5348 - DNA, 20 bp, Artificial
  20-mer unique DNA sequence
tttcggttgcaggtgctggc

SEQ ID NO: 5349 - DNA, 20 bp, Artificial
  20-mer unique DNA sequence
gcgcactcgctccataacga

SEQ ID NO: 5350 - DNA, 20 bp, Artificial
  20-mer unique DNA sequence
aggcggttagggggtgagga

SEQ ID NO: 5351 - DNA, 20 bp, Artificial
  20-mer unique DNA sequence
tcgcccacgactgactgcat

SEQ ID NO: 5352 - DNA, 20 bp, Artificial
  20-mer unique DNA sequence
tccccggctttacctcgcaa

SEQ ID NO: 5353 - DNA, 20 bp, Artificial
  20-mer unique DNA sequence
agggccgaactggtaggggc

SEQ ID NO: 5354 - DNA, 20 bp, Artificial
  20-mer unique DNA sequence
gaagcaacgggaacagcacg

SEQ ID NO: 5355 - DNA, 20 bp, Artificial
  20-mer unique DNA sequence
tggtcgcttcgcttcccttg

SEQ ID NO: 5356 - DNA, 20 bp, Artificial
  20-mer unique DNA sequence
ttgggcgggaacaaggaaga

SEQ ID NO: 5357 - DNA, 20 bp, Artificial
  20-mer unique DNA sequence
ccaccttgtttttgcggacc

SEQ ID NO: 5358 - DNA, 20 bp, Artificial
  20-mer unique DNA sequence
cgccctcccagcatgtcgta

SEQ ID NO: 5359 - DNA, 20 bp, Artificial
  20-mer unique DNA sequence
tcacaagcccgaaccctcca

SEQ ID NO: 5360 - DNA, 20 bp, Artificial
  20-mer unique DNA sequence
atgagcggcgagagggggaa

SEQ ID NO: 5361 - DNA, 20 bp, Artificial
  20-mer unique DNA sequence
ttgcacgagctagacgcgcc

SEQ ID NO: 5362 - DNA, 20 bp, Artificial
  20-mer unique DNA sequence
cctcgccctggttgtgtcct

SEQ ID NO: 5363 - DNA, 20 bp, Artificial
  20-mer unique DNA sequence
gagttatgggcgtcgggtgc

SEQ ID NO: 5364 - DNA, 20 bp, Artificial
  20-mer unique DNA sequence
acatctttgtcgtccctgcg

SEQ ID NO: 5365 - DNA, 20 bp, Artificial
  20-mer unique DNA sequence
ccgccaaccccgtgtacacc

SEQ ID NO: 5366 - DNA, 20 bp, Artificial
  20-mer unique DNA sequence
gcacgggatgggggaaaatt

SEQ ID NO: 5367 - DNA, 20 bp, Artificial
  20-mer unique DNA sequence
cgagggcacgaggttacgca

SEQ ID NO: 5368 - DNA, 20 bp, Artificial
  20-mer unique DNA sequence
gtgggtgagtccggaagggg

SEQ ID NO: 5369 - DNA, 20 bp, Artificial
  20-mer unique DNA sequence
tttcctaagcttccgggccc

SEQ ID NO: 5370 - DNA, 20 bp, Artificial
  20-mer unique DNA sequence
ggggcggggtccttgatact

SEQ ID NO: 5371 - DNA, 20 bp, Artificial
  20-mer unique DNA sequence
ccgtcctgcacctgtttccg

SEQ ID NO: 5372 - DNA, 20 bp, Artificial
  20-mer unique DNA sequence
tcaccacgctcaacccgaag

SEQ ID NO: 5373 - DNA, 20 bp, Artificial
  20-mer unique DNA sequence
agcggtattgccttgggtgc

SEQ ID NO: 5374 - DNA, 20 bp, Artificial
  20-mer unique DNA sequence
taagtcctctcccccgcccc

SEQ ID NO: 5375 - DNA, 20 bp, Artificial
  20-mer unique DNA sequence
gcaaaccgaacgcccagaaa

SEQ ID NO: 5376 - DNA, 20 bp, Artificial
  20-mer unique DNA sequence
agatccggcaaccccgctgt

SEQ ID NO: 5377 - DNA, 20 bp, Artificial
  20-mer unique DNA sequence
ccccaccgagtaccatgtca

SEQ ID NO: 5378 - DNA, 20 bp, Artificial
  20-mer unique DNA sequence
cgcaaagccccacggtaaga

SEQ ID NO: 5379 - DNA, 20 bp, Artificial
  20-mer unique DNA sequence
tgccgtgacgtctgtgactc

SEQ ID NO: 5380 - DNA, 20 bp, Artificial
  20-mer unique DNA sequence
gcctctagccgtccccatgc

SEQ ID NO: 5381 - DNA, 20 bp, Artificial
  20-mer unique DNA sequence
tacggctggggctttgcagg

SEQ ID NO: 5382 - DNA, 20 bp, Artificial
  20-mer unique DNA sequence
gtggggcatattgcaggcga

SEQ ID NO: 5383 - DNA, 20 bp, Artificial
  20-mer unique DNA sequence
cgcgccaccctaacaactga

SEQ ID NO: 5384 - DNA, 20 bp, Artificial
  20-mer unique DNA sequence
agcggccctgagcaagaaaa

SEQ ID NO: 5385 - DNA, 20 bp, Artificial
  20-mer unique DNA sequence
tttcggaggtgagtgcgtgc

SEQ ID NO: 5386 - DNA, 20 bp, Artificial
  20-mer unique DNA sequence
gtgggagcgcgcggataatg

SEQ ID NO: 5387 - DNA, 20 bp, Artificial
  20-mer unique DNA sequence
cctgcagctttccgtcgtcc

SEQ ID NO: 5388 - DNA, 20 bp, Artificial
  20-mer unique DNA sequence
cccgttacgccaggacaagt

SEQ ID NO: 5389 - DNA, 20 bp, Artificial
  20-mer unique DNA sequence
gaacgcgaccgtcctctctt

SEQ ID NO: 5390 - DNA, 20 bp, Artificial
  20-mer unique DNA sequence
cgcggggtttgcctagtgac

SEQ ID NO: 5391 - DNA, 20 bp, Artificial
  20-mer unique DNA sequence
tcagaactcaggcccacccc

SEQ ID NO: 5392 - DNA, 20 bp, Artificial
  20-mer unique DNA sequence
ctttccgcgcaagccatgta

SEQ ID NO: 5393 - DNA, 20 bp, Artificial
  20-mer unique DNA sequence
caggcggatggagcgttacc

SEQ ID NO: 5394 - DNA, 20 bp, Artificial
  20-mer unique DNA sequence
ccagcggggaaaaaaaccgg

SEQ ID NO: 5395 - DNA, 20 bp, Artificial
  20-mer unique DNA sequence
ggcgttccatcgtgcgtcat

SEQ ID NO: 5396 - DNA, 20 bp, Artificial
  20-mer unique DNA sequence
gaaccaattgcccattcgcc

SEQ ID NO: 5397 - DNA, 20 bp, Artificial
  20-mer unique DNA sequence
tggtcacgtgaatcgcggca

SEQ ID NO: 5398 - DNA, 20 bp, Artificial
  20-mer unique DNA sequence
ccgtgccagttcgttcgtcg

SEQ ID NO: 5399 - DNA, 20 bp, Artificial
  20-mer unique DNA sequence
cttatcgcccctcagacccg

SEQ ID NO: 5400 - DNA, 20 bp, Artificial
  20-mer unique DNA sequence
tcctagctagcgacctggca

SEQ ID NO: 5401 - DNA, 20 bp, Artificial
  20-mer unique DNA sequence
cgacacgggttcggagagat

SEQ ID NO: 5402 - DNA, 20 bp, Artificial
  20-mer unique DNA sequence
ctggggcctgtgcgtacgtt

SEQ ID NO: 5403 - DNA, 20 bp, Artificial
  20-mer unique DNA sequence
cctctcccattcctcgcacg

SEQ ID NO: 5404 - DNA, 20 bp, Artificial
  20-mer unique DNA sequence
aatggtaggagaggggcgcc

SEQ ID NO: 5405 - DNA, 20 bp, Artificial
  20-mer unique DNA sequence
tttgtccggagtgcgcatgc

SEQ ID NO: 5406 - DNA, 20 bp, Artificial
  20-mer unique DNA sequence
atcatggggtccgggctttg

SEQ ID NO: 5407 - DNA, 20 bp, Artificial
  20-mer unique DNA sequence
tgtaatccgcgcaaacgtcg

SEQ ID NO: 5408 - DNA, 20 bp, Artificial
  20-mer unique DNA sequence
cacgcccccccctgagatgt

SEQ ID NO: 5409 - DNA, 20 bp, Artificial
  20-mer unique DNA sequence
tgacccccgcacgaatgacc

SEQ ID NO: 5410 - DNA, 20 bp, Artificial
  20-mer unique DNA sequence
cacgccggattctgtccacc

SEQ ID NO: 5411 - DNA, 20 bp, Artificial
  20-mer unique DNA sequence
tgactgacgcccgcctttct

SEQ ID NO: 5412 - DNA, 20 bp, Artificial
  20-mer unique DNA sequence
cccccgctttcttgcatcac

SEQ ID NO: 5413 - DNA, 20 bp, Artificial
  20-mer unique DNA sequence
ccaagccacccctacgccag

SEQ ID NO: 5414 - DNA, 20 bp, Artificial
  20-mer unique DNA sequence
cgtgtaaaaggcgcgaacca

SEQ ID NO: 5415 - DNA, 20 bp, Artificial
  20-mer unique DNA sequence
gagcggtggggacgaggaac

SEQ ID NO: 5416 - DNA, 20 bp, Artificial
  20-mer unique DNA sequence
caaaaccgggaaggcaacgc

SEQ ID NO: 5417 - DNA, 20 bp, Artificial
  20-mer unique DNA sequence
cgccggacccataccacagt

SEQ ID NO: 5418 - DNA, 20 bp, Artificial
  20-mer unique DNA sequence
tttttgcaaccgaagcccgt

SEQ ID NO: 5419 - DNA, 20 bp, Artificial
  20-mer unique DNA sequence
gcggtcttggctgctgttgc

SEQ ID NO: 5420 - DNA, 20 bp, Artificial
  20-mer unique DNA sequence
cggttcacatggggcgtttc

SEQ ID NO: 5421 - DNA, 20 bp, Artificial
  20-mer unique DNA sequence
acctgctcatggcctttttt

SEQ ID NO: 5422 - DNA, 20 bp, Artificial
  20-mer unique DNA sequence
ggatcgcccccagatgagac

SEQ ID NO: 5423 - DNA, 20 bp, Artificial
  20-mer unique DNA sequence
ttatgtcagaacaaccgcgg

SEQ ID NO: 5424 - DNA, 20 bp, Artificial
  20-mer unique DNA sequence
ttgtcccgatagctctgccg

SEQ ID NO: 5425 - DNA, 20 bp, Artificial
  20-mer unique DNA sequence
atgggccctctcggatgttg

SEQ ID NO: 5426 - DNA, 20 bp, Artificial
  20-mer unique DNA sequence
ggtaccccctctgcacagcc

SEQ ID NO: 5427 - DNA, 20 bp, Artificial
  20-mer unique DNA sequence
ccgcttgatgtccgcctttc

SEQ ID NO: 5428 - DNA, 20 bp, Artificial
  20-mer unique DNA sequence
ggcctcaaacgcgcagcata

SEQ ID NO: 5429 - DNA, 20 bp, Artificial
  20-mer unique DNA sequence
gcctgccgatgcccgtatac

SEQ ID NO: 5430 - DNA, 20 bp, Artificial
  20-mer unique DNA sequence
cgggtcatcaaaagggtggc

SEQ ID NO: 5431 - DNA, 20 bp, Artificial
  20-mer unique DNA sequence
tgcgaagtaccccaagcggc

SEQ ID NO: 5432 - DNA, 20 bp, Artificial
  20-mer unique DNA sequence
cacaaacccccgatctcccg

SEQ ID NO: 5433 - DNA, 20 bp, Artificial
  20-mer unique DNA sequence
agggaagcaggatcggggag

SEQ ID NO: 5434 - DNA, 20 bp, Artificial
  20-mer unique DNA sequence
gcgtaggtgcgcggacagag

SEQ ID NO: 5435 - DNA, 20 bp, Artificial
  20-mer unique DNA sequence
gcgcccctctcgtgcttgtt

SEQ ID NO: 5436 - DNA, 20 bp, Artificial
  20-mer unique DNA sequence
cagttagctccgtgcgaggt

SEQ ID NO: 5437 - DNA, 20 bp, Artificial
  20-mer unique DNA sequence
aacgcgtactgacggagtgg

SEQ ID NO: 5438 - DNA, 20 bp, Artificial
  20-mer unique DNA sequence
aggctcacgtgctcgtcaca

SEQ ID NO: 5439 - DNA, 20 bp, Artificial
  20-mer unique DNA sequence
cgatcgccgcgttattcgct

SEQ ID NO: 5440 - DNA, 20 bp, Artificial
  20-mer unique DNA sequence
atacccttacggctgcaccg

SEQ ID NO: 5441 - DNA, 20 bp, Artificial
  20-mer unique DNA sequence
tcaaggactcgtacgctcgg

SEQ ID NO: 5442 - DNA, 20 bp, Artificial
  20-mer unique DNA sequence
atccgtgcgacgctaagcag

SEQ ID NO: 5443 - DNA, 20 bp, Artificial
  20-mer unique DNA sequence
atggacgtccgtgtgttccc

SEQ ID NO: 5444 - DNA, 20 bp, Artificial
  20-mer unique DNA sequence
cgggtccttacgtcgcatct

SEQ ID NO: 5445 - DNA, 20 bp, Artificial
  20-mer unique DNA sequence
cgaccggagttactcacgca

SEQ ID NO: 5446 - DNA, 20 bp, Artificial
  20-mer unique DNA sequence
ggaggtcactatgcggccaa

SEQ ID NO: 5447 - DNA, 20 bp, Artificial
  20-mer unique DNA sequence
catgcgaggttgaccgctct

SEQ ID NO: 5448 - DNA, 20 bp, Artificial
  20-mer unique DNA sequence
cacttgtggtacgggcggtt

SEQ ID NO: 5449 - DNA, 20 bp, Artificial
  20-mer unique DNA sequence
taggcgtggccttagcgaga

SEQ ID NO: 5450 - DNA, 20 bp, Artificial
  20-mer unique DNA sequence
acttccggcaatcacgtgga

SEQ ID NO: 5451 - DNA, 20 bp, Artificial
  20-mer unique DNA sequence
cgacgccctgcgcatataga

SEQ ID NO: 5452 - DNA, 20 bp, Artificial
  20-mer unique DNA sequence
gagcatcgtccagccgacat

SEQ ID NO: 5453 - DNA, 20 bp, Artificial
  20-mer unique DNA sequence
ttcatcccggacacgtcgct

SEQ ID NO: 5454 - DNA, 20 bp, Artificial
  20-mer unique DNA sequence
ttcactcgaccgtggcgact

SEQ ID NO: 5455 - DNA, 20 bp, Artificial
  20-mer unique DNA sequence
aaccggtcgactccggatgt

SEQ ID NO: 5456 - DNA, 20 bp, Artificial
  20-mer unique DNA sequence
tcgaaagcgaccctaggcga

SEQ ID NO: 5457 - DNA, 20 bp, Artificial
  20-mer unique DNA sequence
atctctctgcgcgaccacaa

SEQ ID NO: 5458 - DNA, 20 bp, Artificial
  20-mer unique DNA sequence
tggagcggacagatcaagcc

SEQ ID NO: 5459 - DNA, 20 bp, Artificial
  20-mer unique DNA sequence
tactcacctgggcggaccaa

SEQ ID NO: 5460 - DNA, 20 bp, Artificial
  20-mer unique DNA sequence
ctgtgagcgccagtgtgagt

SEQ ID NO: 5461 - DNA, 20 bp, Artificial
  20-mer unique DNA sequence
tgtcgcgaccgctagcgaaa

SEQ ID NO: 5462 - DNA, 20 bp, Artificial
  20-mer unique DNA sequence
cgcccaccaattcgagctct

SEQ ID NO: 5463 - DNA, 20 bp, Artificial
  20-mer unique DNA sequence
aaaggcggtgctcaatcggg

SEQ ID NO: 5464 - DNA, 20 bp, Artificial
  20-mer unique DNA sequence
ccccacggtcctacccagcc

SEQ ID NO: 5465 - DNA, 20 bp, Artificial
  20-mer unique DNA sequence
gctacacgcgacatcacgcc

SEQ ID NO: 5466 - DNA, 20 bp, Artificial
  20-mer unique DNA sequence
tgtggcggctgcgagatctt

SEQ ID NO: 5467 - DNA, 20 bp, Artificial
  20-mer unique DNA sequence
acggcaggcgtagaatggtt

SEQ ID NO: 5468 - DNA, 20 bp, Artificial
  20-mer unique DNA sequence
accaagctatcacccccgcg

SEQ ID NO: 5469 - DNA, 20 bp, Artificial
  20-mer unique DNA sequence
gttccccgtcttttgccagc

SEQ ID NO: 5470 - DNA, 20 bp, Artificial
  20-mer unique DNA sequence
tacccgtcctggcttctggc

SEQ ID NO: 5471 - DNA, 20 bp, Artificial
  20-mer unique DNA sequence
caacggccgggacatcaaga

SEQ ID NO: 5472 - DNA, 20 bp, Artificial
  20-mer unique DNA sequence
gtgaactgggggcgacttgg

SEQ ID NO: 5473 - DNA, 20 bp, Artificial
  20-mer unique DNA sequence
aagcgattacccctgcacgg

SEQ ID NO: 5474 - DNA, 20 bp, Artificial
  20-mer unique DNA sequence
cgggccagctgaaaagaggt

SEQ ID NO: 5475 - DNA, 20 bp, Artificial
  20-mer unique DNA sequence
cactaaatttccgccccccc

SEQ ID NO: 5476 - DNA, 20 bp, Artificial
  20-mer unique DNA sequence
tttcggtcacccgagttggt

SEQ ID NO: 5477 - DNA, 20 bp, Artificial
  20-mer unique DNA sequence
tgtgccgcagtacctggatt

SEQ ID NO: 5478 - DNA, 20 bp, Artificial
  20-mer unique DNA sequence
atctccaacgggcgaacctg

SEQ ID NO: 5479 - DNA, 20 bp, Artificial
  20-mer unique DNA sequence
gcggccatggttcgatacaa

SEQ ID NO: 5480 - DNA, 20 bp, Artificial
  20-mer unique DNA sequence
cggattcagtccacatgcgg

SEQ ID NO: 5481 - DNA, 20 bp, Artificial
  20-mer unique DNA sequence
ctgccgacgcttcatggacc

SEQ ID NO: 5482 - DNA, 20 bp, Artificial
  20-mer unique DNA sequence
ggacctccccgctggcattt

SEQ ID NO: 5483 - DNA, 20 bp, Artificial
  20-mer unique DNA sequence
gggacgagccatgaccgggt

SEQ ID NO: 5484 - DNA, 20 bp, Artificial
  20-mer unique DNA sequence
tccgaaaggcctgaaagcga

SEQ ID NO: 5485 - DNA, 20 bp, Artificial
  20-mer unique DNA sequence
atttttgcccgacacctccg

SEQ ID NO: 5486 - DNA, 20 bp, Artificial
  20-mer unique DNA sequence
ctccccttgaaatacgcccg

SEQ ID NO: 5487 - DNA, 20 bp, Artificial
  20-mer unique DNA sequence
tctgcgtttcggggtggctt

SEQ ID NO: 5488 - DNA, 20 bp, Artificial
  20-mer unique DNA sequence
acaaacacgcggcaacatcg

SEQ ID NO: 5489 - DNA, 20 bp, Artificial
  20-mer unique DNA sequence
ctgttttttggccgggacga

SEQ ID NO: 5490 - DNA, 20 bp, Artificial
  20-mer unique DNA sequence
acgcgcagactctccccctc

SEQ ID NO: 5491 - DNA, 20 bp, Artificial
  20-mer unique DNA sequence
catgaaaggggggcagtcca

SEQ ID NO: 5492 - DNA, 20 bp, Artificial
  20-mer unique DNA sequence
ggggcactggactcgggatg

SEQ ID NO: 5493 - DNA, 20 bp, Artificial
  20-mer unique DNA sequence
tagggcgtgcgaagggaaat

SEQ ID NO: 5494 - DNA, 20 bp, Artificial
  20-mer unique DNA sequence
cctcgcgcatgctcccaata

SEQ ID NO: 5495 - DNA, 20 bp, Artificial
  20-mer unique DNA sequence
ggggctgagatgtagggcca

SEQ ID NO: 5496 - DNA, 20 bp, Artificial
  20-mer unique DNA sequence
accgcgatgccacaccccca

SEQ ID NO: 5497 - DNA, 20 bp, Artificial
  20-mer unique DNA sequence
cgaacccgccacaacccaga

SEQ ID NO: 5498 - DNA, 20 bp, Artificial
  20-mer unique DNA sequence
ctcgtgtgtttgcggctggc

SEQ ID NO: 5499 - DNA, 20 bp, Artificial
  20-mer unique DNA sequence
ttgaggacttggcaccgcgt

SEQ ID NO: 5500 - DNA, 20 bp, Artificial
  20-mer unique DNA sequence
cgcccagtactcccaacgcc

SEQ ID NO: 5501 - DNA, 20 bp, Artificial
  20-mer unique DNA sequence
tgactttggcgctgaggggg

SEQ ID NO: 5502 - DNA, 20 bp, Artificial
  20-mer unique DNA sequence
tcgggtcgtgcggttctagc

SEQ ID NO: 5503 - DNA, 20 bp, Artificial
  20-mer unique DNA sequence
agcgtttctgcgatgcggtc

SEQ ID NO: 5504 - DNA, 20 bp, Artificial
  20-mer unique DNA sequence
ttcaaaacgcgcggggactg

SEQ ID NO: 5505 - DNA, 20 bp, Artificial
  20-mer unique DNA sequence
accccggctccttcctatgg

SEQ ID NO: 5506 - DNA, 20 bp, Artificial
  20-mer unique DNA sequence
aaaccgccaattcgcagcct

SEQ ID NO: 5507 - DNA, 20 bp, Artificial
  20-mer unique DNA sequence
gcagggcacggttagggaag

SEQ ID NO: 5508 - DNA, 20 bp, Artificial
  20-mer unique DNA sequence
gcctgaatcgacgtgcctca

SEQ ID NO: 5509 - DNA, 20 bp, Artificial
  20-mer unique DNA sequence
tcgaacttccctgggcgaga

SEQ ID NO: 5510 - DNA, 20 bp, Artificial
  20-mer unique DNA sequence
tccatccaaccgccgtcata

SEQ ID NO: 5511 - DNA, 20 bp, Artificial
  20-mer unique DNA sequence
cacctccgaaaatcccgcct

SEQ ID NO: 5512 - DNA, 20 bp, Artificial
  20-mer unique DNA sequence
aaaatggcgcggacaatgca

SEQ ID NO: 5513 - DNA, 20 bp, Artificial
  20-mer unique DNA sequence
agatggacgggcagcaagca

SEQ ID NO: 5514 - DNA, 20 bp, Artificial
  20-mer unique DNA sequence
accctgcacaacgagcccct

SEQ ID NO: 5515 - DNA, 20 bp, Artificial
  20-mer unique DNA sequence
cccgatccgcgcataaagtt

SEQ ID NO: 5516 - DNA, 20 bp, Artificial
  20-mer unique DNA sequence
gacggcgcggagctgagaaa

SEQ ID NO: 5517 - DNA, 20 bp, Artificial
  20-mer unique DNA sequence
gtccgttgggctgcgtgtcc

SEQ ID NO: 5518 - DNA, 20 bp, Artificial
  20-mer unique DNA sequence
acgaccttacccgcacccaa

SEQ ID NO: 5519 - DNA, 20 bp, Artificial
  20-mer unique DNA sequence
actggcttccccgactcccg

SEQ ID NO: 5520 - DNA, 20 bp, Artificial
  20-mer unique DNA sequence
agtgctggaaatgcgtgtcg

SEQ ID NO: 5521 - DNA, 20 bp, Artificial
  20-mer unique DNA sequence
tagaccgcacaaggagcccg

SEQ ID NO: 5522 - DNA, 20 bp, Artificial
  20-mer unique DNA sequence
cttcgggccacggcgattga

SEQ ID NO: 5523 - DNA, 20 bp, Artificial
  20-mer unique DNA sequence
ttggggccgacgatgatgag

SEQ ID NO: 5524 - DNA, 20 bp, Artificial
  20-mer unique DNA sequence
gggagagctcgccgaatgta

SEQ ID NO: 5525 - DNA, 20 bp, Artificial
  20-mer unique DNA sequence
ctatggtggaactcggcggg

SEQ ID NO: 5526 - DNA, 20 bp, Artificial
  20-mer unique DNA sequence
ccaaacacgctaccgaccca

SEQ ID NO: 5527 - DNA, 20 bp, Artificial
  20-mer unique DNA sequence
gtgaagggttaggggcggcg

SEQ ID NO: 5528 - DNA, 20 bp, Artificial
  20-mer unique DNA sequence
cttctcaactcgcctgcccg

SEQ ID NO: 5529 - DNA, 20 bp, Artificial
  20-mer unique DNA sequence
gtgcggggaagttagcgtcg

SEQ ID NO: 5530 - DNA, 20 bp, Artificial
  20-mer unique DNA sequence
attatggagctagcggccgg

SEQ ID NO: 5531 - DNA, 20 bp, Artificial
  20-mer unique DNA sequence
ataaatgggcgatcggggct

SEQ ID NO: 5532 - DNA, 20 bp, Artificial
  20-mer unique DNA sequence
atctcccgttcgcgctctcc

SEQ ID NO: 5533 - DNA, 20 bp, Artificial
  20-mer unique DNA sequence
ccaaatgaggcaagcgggtg

SEQ ID NO: 5534 - DNA, 20 bp, Artificial
  20-mer unique DNA sequence
gtaggtagcgcgctgtacaa

SEQ ID NO: 5535 - DNA, 20 bp, Artificial
  20-mer unique DNA sequence
tgtagcgatcgcgggaagtc

SEQ ID NO: 5536 - DNA, 20 bp, Artificial
  20-mer unique DNA sequence
gcttggactgggggaggttg

SEQ ID NO: 5537 - DNA, 20 bp, Artificial
  20-mer unique DNA sequence
tacatacagcggggaggcgg

SEQ ID NO: 5538 - DNA, 20 bp, Artificial
  20-mer unique DNA sequence
ccggcgatgtcgagatggac

SEQ ID NO: 5539 - DNA, 20 bp, Artificial
  20-mer unique DNA sequence
tgcttacgaccgcgccgatc

SEQ ID NO: 5540 - DNA, 20 bp, Artificial
  20-mer unique DNA sequence
gtcttgggtggcgaatggcg

SEQ ID NO: 5541 - DNA, 20 bp, Artificial
  20-mer unique DNA sequence
agtcgcagcgtgactaccag

SEQ ID NO: 5542 - DNA, 20 bp, Artificial
  20-mer unique DNA sequence
ctgggctgagggagggactg

SEQ ID NO: 5543 - DNA, 20 bp, Artificial
  20-mer unique DNA sequence
acattgaccgcttggccctg

SEQ ID NO: 5544 - DNA, 20 bp, Artificial
  20-mer unique DNA sequence
ttggggtcatggcgggtcta

SEQ ID NO: 5545 - DNA, 20 bp, Artificial
  20-mer unique DNA sequence
cgtgagttgcgaggatggcg

SEQ ID NO: 5546 - DNA, 20 bp, Artificial
  20-mer unique DNA sequence
cctatgacggaacggcccaa

SEQ ID NO: 5547 - DNA, 20 bp, Artificial
  20-mer unique DNA sequence
acgaatcgcgtggacgaaac

SEQ ID NO: 5548 - DNA, 20 bp, Artificial
  20-mer unique DNA sequence
tgatttgtcggttgggcgtc

SEQ ID NO: 5549 - DNA, 20 bp, Artificial
  20-mer unique DNA sequence
atcctgtccccctcttggca

SEQ ID NO: 5550 - DNA, 20 bp, Artificial
  20-mer unique DNA sequence
gccgacacctgcctgaaacc

SEQ ID NO: 5551 - DNA, 20 bp, Artificial
  20-mer unique DNA sequence
gaaaggaacgggggcatcga

SEQ ID NO: 5552 - DNA, 20 bp, Artificial
  20-mer unique DNA sequence
tacgcggttcgtctggcctc

SEQ ID NO: 5553 - DNA, 20 bp, Artificial
  20-mer unique DNA sequence
taggcggccgacggtttagt

SEQ ID NO: 5554 - DNA, 20 bp, Artificial
  20-mer unique DNA sequence
cgccgcttcactataccccg

SEQ ID NO: 5555 - DNA, 20 bp, Artificial
  20-mer unique DNA sequence
gaacatgtccaagggggcgc

SEQ ID NO: 5556 - DNA, 20 bp, Artificial
  20-mer unique DNA sequence
gacacgcaactcaaccgcca

SEQ ID NO: 5557 - DNA, 20 bp, Artificial
  20-mer unique DNA sequence
agggcgggtgtgcaggtatg

SEQ ID NO: 5558 - DNA, 20 bp, Artificial
  20-mer unique DNA sequence
ttccgccgcactgattacga

SEQ ID NO: 5559 - DNA, 20 bp, Artificial
  20-mer unique DNA sequence
tagcgccgggatgtttgcaa

SEQ ID NO: 5560 - DNA, 20 bp, Artificial
  20-mer unique DNA sequence
tgcctggagtggggggagat

SEQ ID NO: 5561 - DNA, 20 bp, Artificial
  20-mer unique DNA sequence
atcagctccaggccggtcca

SEQ ID NO: 5562 - DNA, 20 bp, Artificial
  20-mer unique DNA sequence
agaagcttgccggggtggta

SEQ ID NO: 5563 - DNA, 20 bp, Artificial
  20-mer unique DNA sequence
tgcgggtgccttacatttgg

SEQ ID NO: 5564 - DNA, 20 bp, Artificial
  20-mer unique DNA sequence
ttgatctgccttggaccccc

SEQ ID NO: 5565 - DNA, 20 bp, Artificial
  20-mer unique DNA sequence
accacaccacaaagccggcc

SEQ ID NO: 5566 - DNA, 20 bp, Artificial
  20-mer unique DNA sequence
acaaaaagggcgtcctcggg

SEQ ID NO: 5567 - DNA, 20 bp, Artificial
  20-mer unique DNA sequence
tgagatttgcgtcttgccgg

SEQ ID NO: 5568 - DNA, 20 bp, Artificial
  20-mer unique DNA sequence
gcgtattggtcggtgggcga

SEQ ID NO: 5569 - DNA, 20 bp, Artificial
  20-mer unique DNA sequence
tcgcagttccagtgttgggc

SEQ ID NO: 5570 - DNA, 20 bp, Artificial
  20-mer unique DNA sequence
cggcgttcacgacagtggtt

SEQ ID NO: 5571 - DNA, 20 bp, Artificial
  20-mer unique DNA sequence
caagtgcctgacgttcgcct

SEQ ID NO: 5572 - DNA, 20 bp, Artificial
  20-mer unique DNA sequence
ttaacggggctgcgtgtggc

SEQ ID NO: 5573 - DNA, 20 bp, Artificial
  20-mer unique DNA sequence
ctcacccgcccagacgtttt

SEQ ID NO: 5574 - DNA, 20 bp, Artificial
  20-mer unique DNA sequence
cttcctggcggggcgtgttt

SEQ ID NO: 5575 - DNA, 20 bp, Artificial
  20-mer unique DNA sequence
ggcttgcgttggggaattgg

SEQ ID NO: 5576 - DNA, 20 bp, Artificial
  20-mer unique DNA sequence
tgcaaaggcgtcgtcaggtt

SEQ ID NO: 5577 - DNA, 20 bp, Artificial
  20-mer unique DNA sequence
aggactcaatccaccaccac

SEQ ID NO: 5578 - DNA, 20 bp, Artificial
  20-mer unique DNA sequence
cgacacccgaagcaggcaac

SEQ ID NO: 5579 - DNA, 20 bp, Artificial
  20-mer unique DNA sequence
gtcaaccgcacccctgtcca

SEQ ID NO: 5580 - DNA, 20 bp, Artificial
  20-mer unique DNA sequence
gcgcgggggcatctaggtgt

SEQ ID NO: 5581 - DNA, 20 bp, Artificial
  20-mer unique DNA sequence
cccgccctaggatgcaagtc

SEQ ID NO: 5582 - DNA, 20 bp, Artificial
  20-mer unique DNA sequence
ggagtttggcctgtacgccc

SEQ ID NO: 5583 - DNA, 20 bp, Artificial
  20-mer unique DNA sequence
gccgcagaaaagacccgcta

SEQ ID NO: 5584 - DNA, 20 bp, Artificial
  20-mer unique DNA sequence
tgctcaacagaccccccacg

SEQ ID NO: 5585 - DNA, 20 bp, Artificial
  20-mer unique DNA sequence
cgtcgcgcgtgtctctgtct

SEQ ID NO: 5586 - DNA, 20 bp, Artificial
  20-mer unique DNA sequence
ggtcccaattcctcacgccg

SEQ ID NO: 5587 - DNA, 20 bp, Artificial
  20-mer unique DNA sequence
ggttaaggagcgagggggcg

SEQ ID NO: 5588 - DNA, 20 bp, Artificial
  20-mer unique DNA sequence
acccatcccacgcaatcgaa

SEQ ID NO: 5589 - DNA, 20 bp, Artificial
  20-mer unique DNA sequence
cgcacatatcggtccccagg

SEQ ID NO: 5590 - DNA, 20 bp, Artificial
  20-mer unique DNA sequence
ccgggaatatgtagggccca

SEQ ID NO: 5591 - DNA, 20 bp, Artificial
  20-mer unique DNA sequence
agaagccgcgatcccacgtc

SEQ ID NO: 5592 - DNA, 20 bp, Artificial
  20-mer unique DNA sequence
ccgttctcccccgatcctct

SEQ ID NO: 5593 - DNA, 20 bp, Artificial
  20-mer unique DNA sequence
ccgcccgagcacgaataaac

SEQ ID NO: 5594 - DNA, 20 bp, Artificial
  20-mer unique DNA sequence
atcgcagtctagccttgcgg

SEQ ID NO: 5595 - DNA, 20 bp, Artificial
  20-mer unique DNA sequence
tggggtccaccggtatccaa

SEQ ID NO: 5596 - DNA, 20 bp, Artificial
  20-mer unique DNA sequence
caccccccaaaagaggcaga

SEQ ID NO: 5597 - DNA, 20 bp, Artificial
  20-mer unique DNA sequence
ggatagggaactcgggcggc

SEQ ID NO: 5598 - DNA, 20 bp, Artificial
  20-mer unique DNA sequence
cggaactgctgccccaccta

SEQ ID NO: 5599 - DNA, 20 bp, Artificial
  20-mer unique DNA sequence
cacgagcggagggaggaatc

SEQ ID NO: 5600 - DNA, 20 bp, Artificial
  20-mer unique DNA sequence
cagtatggcgaccagcctgt

SEQ ID NO: 5601 - DNA, 20 bp, Artificial
  20-mer unique DNA sequence
taactaaacgggcgctgcca

SEQ ID NO: 5602 - DNA, 20 bp, Artificial
  20-mer unique DNA sequence
ctcgcggccacaaaagctca

SEQ ID NO: 5603 - DNA, 20 bp, Artificial
  20-mer unique DNA sequence
gtttgagcgacggcaggtga

SEQ ID NO: 5604 - DNA, 20 bp, Artificial
  20-mer unique DNA sequence
gtgattttcggtgcgacgcc

SEQ ID NO: 5605 - DNA, 20 bp, Artificial
  20-mer unique DNA sequence
tacttggtctgccgcctggc

SEQ ID NO: 5606 - DNA, 20 bp, Artificial
  20-mer unique DNA sequence
actcccatccaaccgaccca

SEQ ID NO: 5607 - DNA, 20 bp, Artificial
  20-mer unique DNA sequence
atgatgtacccgcggccttc

SEQ ID NO: 5608 - DNA, 20 bp, Artificial
  20-mer unique DNA sequence
cgccggccttttcattggta

SEQ ID NO: 5609 - DNA, 20 bp, Artificial
  20-mer unique DNA sequence
tgaaccgcaccacccagcta

SEQ ID NO: 5610 - DNA, 20 bp, Artificial
  20-mer unique DNA sequence
cgaaaggtcaacggcagggc

SEQ ID NO: 5611 - DNA, 20 bp, Artificial
  20-mer unique DNA sequence
cctcaacaatatgccccccg

SEQ ID NO: 5612 - DNA, 20 bp, Artificial
  20-mer unique DNA sequence
aagccgcgggataagaagtg

SEQ ID NO: 5613 - DNA, 20 bp, Artificial
  20-mer unique DNA sequence
gcagccgcccaataacctcg

SEQ ID NO: 5614 - DNA, 20 bp, Artificial
  20-mer unique DNA sequence
cgcgcccgttgatggatgat

SEQ ID NO: 5615 - DNA, 20 bp, Artificial
  20-mer unique DNA sequence
cggtggtgctcctgttcgtg

SEQ ID NO: 5616 - DNA, 20 bp, Artificial
  20-mer unique DNA sequence
tcagcccccccagtgttgtc

SEQ ID NO: 5617 - DNA, 20 bp, Artificial
  20-mer unique DNA sequence
cgccttgagtcaccacccgt

SEQ ID NO: 5618 - DNA, 20 bp, Artificial
  20-mer unique DNA sequence
tgattcttctccgcaccgag

SEQ ID NO: 5619 - DNA, 20 bp, Artificial
  20-mer unique DNA sequence
acccagtaggctagagcggt

SEQ ID NO: 5620 - DNA, 20 bp, Artificial
  20-mer unique DNA sequence
ccttacgccaccgctcccta

SEQ ID NO: 5621 - DNA, 20 bp, Artificial
  20-mer unique DNA sequence
ttatgtggttcgcgcccgtc

SEQ ID NO: 5622 - DNA, 20 bp, Artificial
  20-mer unique DNA sequence
aagcacagggaagagccgca

SEQ ID NO: 5623 - DNA, 20 bp, Artificial
  20-mer unique DNA sequence
ttcggaggattgggctggac

SEQ ID NO: 5624 - DNA, 20 bp, Artificial
  20-mer unique DNA sequence
tcaagaggcgcgggatcact

SEQ ID NO: 5625 - DNA, 20 bp, Artificial
  20-mer unique DNA sequence
cccattggccgggtcgttaa

SEQ ID NO: 5626 - DNA, 20 bp, Artificial
  20-mer unique DNA sequence
cagtcggcaggtggtaggcc

SEQ ID NO: 5627 - DNA, 20 bp, Artificial
  20-mer unique DNA sequence
tcgttgctgtatccctcgcg

SEQ ID NO: 5628 - DNA, 20 bp, Artificial
  20-mer unique DNA sequence
ccgaatcagcccaaggccac

SEQ ID NO: 5629 - DNA, 20 bp, Artificial
  20-mer unique DNA sequence
ggcccggacaaaaaaggcag

SEQ ID NO: 5630 - DNA, 20 bp, Artificial
  20-mer unique DNA sequence
tgctggttgactccgtgggg

SEQ ID NO: 5631 - DNA, 20 bp, Artificial
  20-mer unique DNA sequence
gccgcccaataccgaagacg

SEQ ID NO: 5632 - DNA, 20 bp, Artificial
  20-mer unique DNA sequence
cgctgccgcatttgagaaag

SEQ ID NO: 5633 - DNA, 20 bp, Artificial
  20-mer unique DNA sequence
ccgtttcactcgcatcgcat

SEQ ID NO: 5634 - DNA, 20 bp, Artificial
  20-mer unique DNA sequence
gacgcacactcctcccccat

SEQ ID NO: 5635 - DNA, 20 bp, Artificial
  20-mer unique DNA sequence
cgcaccacactagcccccac

SEQ ID NO: 5636 - DNA, 20 bp, Artificial
  20-mer unique DNA sequence
tgttctcccccccagccagc

SEQ ID NO: 5637 - DNA, 20 bp, Artificial
  20-mer unique DNA sequence
aatggacggggcaacacagg

SEQ ID NO: 5638 - DNA, 20 bp, Artificial
  20-mer unique DNA sequence
tcgggggatagcggtttgga

SEQ ID NO: 5639 - DNA, 20 bp, Artificial
  20-mer unique DNA sequence
tctggtgccggggatgaaca

SEQ ID NO: 5640 - DNA, 20 bp, Artificial
  20-mer unique DNA sequence
ccgatgggggcaacctgttt

SEQ ID NO: 5641 - DNA, 20 bp, Artificial
  20-mer unique DNA sequence
tcccgcattcagagcccatt

SEQ ID NO: 5642 - DNA, 20 bp, Artificial
  20-mer unique DNA sequence
agaaacatccgggcgcacaa

SEQ ID NO: 5643 - DNA, 20 bp, Artificial
  20-mer unique DNA sequence
ttcggagacttcggggggtc

SEQ ID NO: 5644 - DNA, 20 bp, Artificial
  20-mer unique DNA sequence
ccccttccacgtgctttgcg

SEQ ID NO: 5645 - DNA, 20 bp, Artificial
  20-mer unique DNA sequence
cgcgattgggcctgtttgct

SEQ ID NO: 5646 - DNA, 20 bp, Artificial
  20-mer unique DNA sequence
tgaccttctttttggcggcg

SEQ ID NO: 5647 - DNA, 20 bp, Artificial
  20-mer unique DNA sequence
atcgtcaacccgccaaaacg

SEQ ID NO: 5648 - DNA, 20 bp, Artificial
  20-mer unique DNA sequence
ttcagccccgatccagagcc

SEQ ID NO: 5649 - DNA, 20 bp, Artificial
  20-mer unique DNA sequence
cgagaaaggaaccgccgatg

SEQ ID NO: 5650 - DNA, 20 bp, Artificial
  20-mer unique DNA sequence
ctgctccgccgttatccacc

SEQ ID NO: 5651 - DNA, 20 bp, Artificial
  20-mer unique DNA sequence
ctgaagaccctgcgcgtggg

SEQ ID NO: 5652 - DNA, 20 bp, Artificial
  20-mer unique DNA sequence
cctttcagggacgggaccgg

SEQ ID NO: 5653 - DNA, 20 bp, Artificial
  20-mer unique DNA sequence
atatcggccaccccctgctc

SEQ ID NO: 5654 - DNA, 20 bp, Artificial
  20-mer unique DNA sequence
gggtaaatgggaccgtgcgg

SEQ ID NO: 5655 - DNA, 20 bp, Artificial
  20-mer unique DNA sequence
tacgtgtccgccccacctcc

SEQ ID NO: 5656 - DNA, 20 bp, Artificial
  20-mer unique DNA sequence
agccctgccaacctacgtcg

SEQ ID NO: 5657 - DNA, 20 bp, Artificial
  20-mer unique DNA sequence
gtagtgcgggaaaagggggc

SEQ ID NO: 5658 - DNA, 20 bp, Artificial
  20-mer unique DNA sequence
ccttacaacaaccgcccccc

SEQ ID NO: 5659 - DNA, 20 bp, Artificial
  20-mer unique DNA sequence
aaccccgtcccgtcttcgct

SEQ ID NO: 5660 - DNA, 20 bp, Artificial
  20-mer unique DNA sequence
ccgttattgtggtgcgcggg

SEQ ID NO: 5661 - DNA, 20 bp, Artificial
  20-mer unique DNA sequence
accaccccttaaacggccgc

SEQ ID NO: 5662 - DNA, 20 bp, Artificial
  20-mer unique DNA sequence
ctacccatcccctgccgtcg

SEQ ID NO: 5663 - DNA, 20 bp, Artificial
  20-mer unique DNA sequence
ccggaagggcgcacgattat

SEQ ID NO: 5664 - DNA, 20 bp, Artificial
  20-mer unique DNA sequence
ctcgggaaacggggcttgat

SEQ ID NO: 5665 - DNA, 20 bp, Artificial
  20-mer unique DNA sequence
cgtaggaacagtggcgcgag

SEQ ID NO: 5666 - DNA, 20 bp, Artificial
  20-mer unique DNA sequence
agtcaaaagggcgcgagtcc

SEQ ID NO: 5667 - DNA, 20 bp, Artificial
  20-mer unique DNA sequence
cgccaatgtcaaccccggag

SEQ ID NO: 5668 - DNA, 20 bp, Artificial
  20-mer unique DNA sequence
aagtgacccgcagtcgcaca

SEQ ID NO: 5669 - DNA, 20 bp, Artificial
  20-mer unique DNA sequence
acacagggctagtccgcagt

SEQ ID NO: 5670 - DNA, 20 bp, Artificial
  20-mer unique DNA sequence
aaaaaaactggtcgggggcg

SEQ ID NO: 5671 - DNA, 20 bp, Artificial
  20-mer unique DNA sequence
gcccacgcgaccatgcatct

SEQ ID NO: 5672 - DNA, 20 bp, Artificial
  20-mer unique DNA sequence
gatgcgtttttggggcgaag

SEQ ID NO: 5673 - DNA, 20 bp, Artificial
  20-mer unique DNA sequence
cccccttttctgtggtcgca

SEQ ID NO: 5674 - DNA, 20 bp, Artificial
  20-mer unique DNA sequence
cccacacttaacgccgcagc

SEQ ID NO: 5675 - DNA, 20 bp, Artificial
  20-mer unique DNA sequence
catgccaatccagccccacg

SEQ ID NO: 5676 - DNA, 20 bp, Artificial
  20-mer unique DNA sequence
gcgtctttgtcgccatgggc

SEQ ID NO: 5677 - DNA, 20 bp, Artificial
  20-mer unique DNA sequence
gcaaaggcgacaaggaccgt

SEQ ID NO: 5678 - DNA, 20 bp, Artificial
  20-mer unique DNA sequence
gcttcttgggtggcattcgg

SEQ ID NO: 5679 - DNA, 20 bp, Artificial
  20-mer unique DNA sequence
ctcccgaacaggcaaaccgc

SEQ ID NO: 5680 - DNA, 20 bp, Artificial
  20-mer unique DNA sequence
tgctgctttcggttccctca

SEQ ID NO: 5681 - DNA, 20 bp, Artificial
  20-mer unique DNA sequence
aaggcaccccacccagcatc

SEQ ID NO: 5682 - DNA, 20 bp, Artificial
  20-mer unique DNA sequence
cacccaagccctccctccac

SEQ ID NO: 5683 - DNA, 20 bp, Artificial
  20-mer unique DNA sequence
catagcgcgcgggaatctca

SEQ ID NO: 5684 - DNA, 20 bp, Artificial
  20-mer unique DNA sequence
gcaaggagcggaaggctggg

SEQ ID NO: 5685 - DNA, 20 bp, Artificial
  20-mer unique DNA sequence
gggaggggtttctggcggag

SEQ ID NO: 5686 - DNA, 20 bp, Artificial
  20-mer unique DNA sequence
tgacgaattttgaacccgcg

SEQ ID NO: 5687 - DNA, 20 bp, Artificial
  20-mer unique DNA sequence
ccgaggttgtatgggagcgc

SEQ ID NO: 5688 - DNA, 20 bp, Artificial
  20-mer unique DNA sequence
tgacgcgccagccttacttg

SEQ ID NO: 5689 - DNA, 20 bp, Artificial
  20-mer unique DNA sequence
ttttggggttggcggtggac

SEQ ID NO: 5690 - DNA, 20 bp, Artificial
  20-mer unique DNA sequence
tgggtttctagccgagcgac

SEQ ID NO: 5691 - DNA, 20 bp, Artificial
  20-mer unique DNA sequence
atccctgacaggcccttgtg

SEQ ID NO: 5692 - DNA, 20 bp, Artificial
  20-mer unique DNA sequence
agagcggcgacgaggagagg

SEQ ID NO: 5693 - DNA, 20 bp, Artificial
  20-mer unique DNA sequence
tcgccctgacgcctaccatt

SEQ ID NO: 5694 - DNA, 20 bp, Artificial
  20-mer unique DNA sequence
ggccgatgcctaatgcttgc

SEQ ID NO: 5695 - DNA, 20 bp, Artificial
  20-mer unique DNA sequence
ggttccagggtgggcgctta

SEQ ID NO: 5696 - DNA, 20 bp, Artificial
  20-mer unique DNA sequence
caccgcatcacccaccgtct

SEQ ID NO: 5697 - DNA, 20 bp, Artificial
  20-mer unique DNA sequence
caattgcatccacaggccgt

SEQ ID NO: 5698 - DNA, 20 bp, Artificial
  20-mer unique DNA sequence
tgggtgcggattctagggcc

SEQ ID NO: 5699 - DNA, 20 bp, Artificial
  20-mer unique DNA sequence
agacgggggagtaggcggtt

SEQ ID NO: 5700 - DNA, 20 bp, Artificial
  20-mer unique DNA sequence
tcttgttgtggtgcggggca

SEQ ID NO: 5701 - DNA, 20 bp, Artificial
  20-mer unique DNA sequence
atggggggctcagggagagg

SEQ ID NO: 5702 - DNA, 20 bp, Artificial
  20-mer unique DNA sequence
accgcgaccttcaccaccga

SEQ ID NO: 5703 - DNA, 20 bp, Artificial
  20-mer unique DNA sequence
caaccgcgcaaggagcatca

SEQ ID NO: 5704 - DNA, 20 bp, Artificial
  20-mer unique DNA sequence
cctgtgtctgggcacctgcg

SEQ ID NO: 5705 - DNA, 20 bp, Artificial
  20-mer unique DNA sequence
ggggcttggggtacgtgagg

SEQ ID NO: 5706 - DNA, 20 bp, Artificial
  20-mer unique DNA sequence
ccccctgtggatgtttggcc

SEQ ID NO: 5707 - DNA, 20 bp, Artificial
  20-mer unique DNA sequence
tggcgggtaggtcgaggaac

SEQ ID NO: 5708 - DNA, 20 bp, Artificial
  20-mer unique DNA sequence
gccttgggtggtgccgttat

SEQ ID NO: 5709 - DNA, 20 bp, Artificial
  20-mer unique DNA sequence
caggggtacgggacgggaat

SEQ ID NO: 5710 - DNA, 20 bp, Artificial
  20-mer unique DNA sequence
cccaaggttcgcactcggtc

SEQ ID NO: 5711 - DNA, 20 bp, Artificial
  20-mer unique DNA sequence
ttgggccgccggtgtaaatc

SEQ ID NO: 5712 - DNA, 20 bp, Artificial
  20-mer unique DNA sequence
ttgcttgcgcggacttttcg

SEQ ID NO: 5713 - DNA, 20 bp, Artificial
  20-mer unique DNA sequence
aggatgtgcgcttccggctg

SEQ ID NO: 5714 - DNA, 20 bp, Artificial
  20-mer unique DNA sequence
accactttgttccgccaccc

SEQ ID NO: 5715 - DNA, 20 bp, Artificial
  20-mer unique DNA sequence
gagacccctatgcgcaccga

SEQ ID NO: 5716 - DNA, 20 bp, Artificial
  20-mer unique DNA sequence
ggttgtggggcaggcagtcg

SEQ ID NO: 5717 - DNA, 20 bp, Artificial
  20-mer unique DNA sequence
tgggagggagcgaaagccta

SEQ ID NO: 5718 - DNA, 20 bp, Artificial
  20-mer unique DNA sequence
aaggattgtgtttgccccgc

SEQ ID NO: 5719 - DNA, 20 bp, Artificial
  20-mer unique DNA sequence
ctccgccgccgactcatctc

SEQ ID NO: 5720 - DNA, 20 bp, Artificial
  20-mer unique DNA sequence
gttgtccaaggcccgtcccc

SEQ ID NO: 5721 - DNA, 20 bp, Artificial
  20-mer unique DNA sequence
tggttgtgtgagtgcgcggc

SEQ ID NO: 5722 - DNA, 20 bp, Artificial
  20-mer unique DNA sequence
tcactccgccctcgcctctt

SEQ ID NO: 5723 - DNA, 20 bp, Artificial
  20-mer unique DNA sequence
ccaatgagggagggagcgaa

SEQ ID NO: 5724 - DNA, 20 bp, Artificial
  20-mer unique DNA sequence
ggggtcctagttcgcgcgag

SEQ ID NO: 5725 - DNA, 20 bp, Artificial
  20-mer unique DNA sequence
tgcacccacaccacacaccc

SEQ ID NO: 5726 - DNA, 20 bp, Artificial
  20-mer unique DNA sequence
acagccatgagccgaccctc

SEQ ID NO: 5727 - DNA, 20 bp, Artificial
  20-mer unique DNA sequence
tttaggcattccgggacggg

SEQ ID NO: 5728 - DNA, 20 bp, Artificial
  20-mer unique DNA sequence
atcggacgtgggctgcttgc

SEQ ID NO: 5729 - DNA, 20 bp, Artificial
  20-mer unique DNA sequence
agtaaaggcgtaggcccggg

SEQ ID NO: 5730 - DNA, 20 bp, Artificial
  20-mer unique DNA sequence
tgccttgtagctccgcgcgt

SEQ ID NO: 5731 - DNA, 20 bp, Artificial
  20-mer unique DNA sequence
cgtgttcgggtggcccttag

SEQ ID NO: 5732 - DNA, 20 bp, Artificial
  20-mer unique DNA sequence
aagccaaatgcgatcccacc

SEQ ID NO: 5733 - DNA, 20 bp, Artificial
  20-mer unique DNA sequence
gggcgaaagaacgtagggcg

SEQ ID NO: 5734 - DNA, 20 bp, Artificial
  20-mer unique DNA sequence
acccacatcaccctcttcgg

SEQ ID NO: 5735 - DNA, 20 bp, Artificial
  20-mer unique DNA sequence
caagcctcacccgcctatcc

SEQ ID NO: 5736 - DNA, 20 bp, Artificial
  20-mer unique DNA sequence
ctatgagaaggtcggggcgg

SEQ ID NO: 5737 - DNA, 20 bp, Artificial
  20-mer unique DNA sequence
cccgcaacaaacccatccct

SEQ ID NO: 5738 - DNA, 20 bp, Artificial
  20-mer unique DNA sequence
ttaactatcgggcaggcggg

SEQ ID NO: 5739 - DNA, 20 bp, Artificial
  20-mer unique DNA sequence
aagcgcgtgttgatggatgg

SEQ ID NO: 5740 - DNA, 20 bp, Artificial
  20-mer unique DNA sequence
ttggcgataaccacaccgga

SEQ ID NO: 5741 - DNA, 20 bp, Artificial
  20-mer unique DNA sequence
gctagtctccctggcgccac

SEQ ID NO: 5742 - DNA, 20 bp, Artificial
  20-mer unique DNA sequence
gccgcgcattaccaacatag

SEQ ID NO: 5743 - DNA, 20 bp, Artificial
  20-mer unique DNA sequence
tgcgcgtacagggctaacaa

SEQ ID NO: 5744 - DNA, 20 bp, Artificial
  20-mer unique DNA sequence
ctccccggtcaagctgcaga

SEQ ID NO: 5745 - DNA, 20 bp, Artificial
  20-mer unique DNA sequence
tatcttcgcccacccacgcc

SEQ ID NO: 5746 - DNA, 20 bp, Artificial
  20-mer unique DNA sequence
tagatcatgcgcacgcggta

SEQ ID NO: 5747 - DNA, 20 bp, Artificial
  20-mer unique DNA sequence
tgcttcagtcagcccagtgt

SEQ ID NO: 5748 - DNA, 20 bp, Artificial
  20-mer unique DNA sequence
ttagtttatgcgtggcggcg

SEQ ID NO: 5749 - DNA, 20 bp, Artificial
  20-mer unique DNA sequence
ggagggaggcggcggagtta

SEQ ID NO: 5750 - DNA, 20 bp, Artificial
  20-mer unique DNA sequence
tacccccccttttacccccg

SEQ ID NO: 5751 - DNA, 20 bp, Artificial
  20-mer unique DNA sequence
tgtccctcctgcccgttttt

SEQ ID NO: 5752 - DNA, 20 bp, Artificial
  20-mer unique DNA sequence
aatcatcgaacggcacgcgt

SEQ ID NO: 5753 - DNA, 20 bp, Artificial
  20-mer unique DNA sequence
tgcgcatctccggttgctag

SEQ ID NO: 5754 - DNA, 20 bp, Artificial
  20-mer unique DNA sequence
gcgcatctacgggggaacca

SEQ ID NO: 5755 - DNA, 20 bp, Artificial
  20-mer unique DNA sequence
cctggggggggaaaatgttg

SEQ ID NO: 5756 - DNA, 20 bp, Artificial
  20-mer unique DNA sequence
ccgtatgggtggttggccga

SEQ ID NO: 5757 - DNA, 20 bp, Artificial
  20-mer unique DNA sequence
ttcgatgtagcggcgttggc

SEQ ID NO: 5758 - DNA, 20 bp, Artificial
  20-mer unique DNA sequence
gtaaacgccggctgcatccg

SEQ ID NO: 5759 - DNA, 20 bp, Artificial
  20-mer unique DNA sequence
acgtgatctgcattggccca

SEQ ID NO: 5760 - DNA, 20 bp, Artificial
  20-mer unique DNA sequence
cctcctccgccccgacaatc

SEQ ID NO: 5761 - DNA, 20 bp, Artificial
  20-mer unique DNA sequence
acaccccccctcccctttgg

SEQ ID NO: 5762 - DNA, 20 bp, Artificial
  20-mer unique DNA sequence
ttgccccgtgtcttcccctt

SEQ ID NO: 5763 - DNA, 20 bp, Artificial
  20-mer unique DNA sequence
cacgctcccgtctcttccca

SEQ ID NO: 5764 - DNA, 20 bp, Artificial
  20-mer unique DNA sequence
ggcggggaagtttgagcgat

SEQ ID NO: 5765 - DNA, 20 bp, Artificial
  20-mer unique DNA sequence
cgcgtgttcattctctcggg

SEQ ID NO: 5766 - DNA, 20 bp, Artificial
  20-mer unique DNA sequence
cccgaacaccacacgcactg

SEQ ID NO: 5767 - DNA, 20 bp, Artificial
  20-mer unique DNA sequence
cgctcgctcgtcgtccttct

SEQ ID NO: 5768 - DNA, 20 bp, Artificial
  20-mer unique DNA sequence
ggttctggtgggtacggggc

SEQ ID NO: 5769 - DNA, 20 bp, Artificial
  20-mer unique DNA sequence
gccgcggaggaagaagcatc

SEQ ID NO: 5770 - DNA, 20 bp, Artificial
  20-mer unique DNA sequence
acacgcgattttggcaccca

SEQ ID NO: 5771 - DNA, 20 bp, Artificial
  20-mer unique DNA sequence
cggtcgtcccatttacggct

SEQ ID NO: 5772 - DNA, 20 bp, Artificial
  20-mer unique DNA sequence
tccaccttccgtcctgcccc

SEQ ID NO: 5773 - DNA, 20 bp, Artificial
  20-mer unique DNA sequence
catattgcggccggcttaca

SEQ ID NO: 5774 - DNA, 20 bp, Artificial
  20-mer unique DNA sequence
ctgcgggatctgctacgtga

SEQ ID NO: 5775 - DNA, 20 bp, Artificial
  20-mer unique DNA sequence
tggcagttgggttcgtggga

SEQ ID NO: 5776 - DNA, 20 bp, Artificial
  20-mer unique DNA sequence
accctttcccctcccgacgc

SEQ ID NO: 5777 - DNA, 20 bp, Artificial
  20-mer unique DNA sequence
ctggtggctcgcgttactgg

SEQ ID NO: 5778 - DNA, 20 bp, Artificial
  20-mer unique DNA sequence
acgccccttcattaccgctg

SEQ ID NO: 5779 - DNA, 20 bp, Artificial
  20-mer unique DNA sequence
aaagcttcgatctgcgcccc

SEQ ID NO: 5780 - DNA, 20 bp, Artificial
  20-mer unique DNA sequence
ttctgagcccctctccctcg

SEQ ID NO: 5781 - DNA, 20 bp, Artificial
  20-mer unique DNA sequence
catacgacgcacaccccagc

SEQ ID NO: 5782 - DNA, 20 bp, Artificial
  20-mer unique DNA sequence
agggccgaccacacactggc

SEQ ID NO: 5783 - DNA, 20 bp, Artificial
  20-mer unique DNA sequence
gcgatgcgattttggatggg

SEQ ID NO: 5784 - DNA, 20 bp, Artificial
  20-mer unique DNA sequence
agccacctcctgcctcccac

SEQ ID NO: 5785 - DNA, 20 bp, Artificial
  20-mer unique DNA sequence
cggaagcagaaccaagccgc

SEQ ID NO: 5786 - DNA, 20 bp, Artificial
  20-mer unique DNA sequence
agccctcccctgtccccctc

SEQ ID NO: 5787 - DNA, 20 bp, Artificial
  20-mer unique DNA sequence
atctgccttcgcttgccgct

SEQ ID NO: 5788 - DNA, 20 bp, Artificial
  20-mer unique DNA sequence
tcaggcactaacccacccgc

SEQ ID NO: 5789 - DNA, 20 bp, Artificial
  20-mer unique DNA sequence
tttcggcttcgggtggttgc

SEQ ID NO: 5790 - DNA, 20 bp, Artificial
  20-mer unique DNA sequence
gcccaccctcgcataacgat

SEQ ID NO: 5791 - DNA, 20 bp, Artificial
  20-mer unique DNA sequence
cgacctcatgcggcacaatc

SEQ ID NO: 5792 - DNA, 20 bp, Artificial
  20-mer unique DNA sequence
cagcccagatgatgccgaga

SEQ ID NO: 5793 - DNA, 20 bp, Artificial
  20-mer unique DNA sequence
tgccattccgctgccctatt

SEQ ID NO: 5794 - DNA, 20 bp, Artificial
  20-mer unique DNA sequence
agaacggaggggatggcagc

SEQ ID NO: 5795 - DNA, 20 bp, Artificial
  20-mer unique DNA sequence
cggatttctcccccgccaga

SEQ ID NO: 5796 - DNA, 20 bp, Artificial
  20-mer unique DNA sequence
attgggtagggggtcggata

SEQ ID NO: 5797 - DNA, 20 bp, Artificial
  20-mer unique DNA sequence
ccgcggggttgaggaatcgt

SEQ ID NO: 5798 - DNA, 20 bp, Artificial
  20-mer unique DNA sequence
agatgacctgcccaaccgcc

SEQ ID NO: 5799 - DNA, 20 bp, Artificial
  20-mer unique DNA sequence
atcgccttaacgccactgcc

SEQ ID NO: 5800 - DNA, 20 bp, Artificial
  20-mer unique DNA sequence
cgctcatcttgccccccatt

SEQ ID NO: 5801 - DNA, 20 bp, Artificial
  20-mer unique DNA sequence
cgttaaccgagggggcatgc

SEQ ID NO: 5802 - DNA, 20 bp, Artificial
  20-mer unique DNA sequence
tccgcccgagttccttttca

SEQ ID NO: 5803 - DNA, 20 bp, Artificial
  20-mer unique DNA sequence
ctccgccctcttctcgtccg

SEQ ID NO: 5804 - DNA, 20 bp, Artificial
  20-mer unique DNA sequence
ataattcgcccaacgggtgg

SEQ ID NO: 5805 - DNA, 20 bp, Artificial
  20-mer unique DNA sequence
attgttgagcgagcgggtgc

SEQ ID NO: 5806 - DNA, 20 bp, Artificial
  20-mer unique DNA sequence
ttctccgaatacccgcctcc

SEQ ID NO: 5807 - DNA, 20 bp, Artificial
  20-mer unique DNA sequence
aatcggtgcgggtgtgggag

SEQ ID NO: 5808 - DNA, 20 bp, Artificial
  20-mer unique DNA sequence
aattcgcaaaggtccagccg

SEQ ID NO: 5809 - DNA, 20 bp, Artificial
  20-mer unique DNA sequence
acatcggggcgtaagggcat

SEQ ID NO: 5810 - DNA, 20 bp, Artificial
  20-mer unique DNA sequence
tgccacggatccaagaagca

SEQ ID NO: 5811 - DNA, 20 bp, Artificial
  20-mer unique DNA sequence
gtgccggggatttccgaagg

SEQ ID NO: 5812 - DNA, 20 bp, Artificial
  20-mer unique DNA sequence
tgcgaatctggggtcaccgg

SEQ ID NO: 5813 - DNA, 20 bp, Artificial
  20-mer unique DNA sequence
ggttcttgggccgcttatgc

SEQ ID NO: 5814 - DNA, 20 bp, Artificial
  20-mer unique DNA sequence
ctatcgttgggtcgctggcg

SEQ ID NO: 5815 - DNA, 20 bp, Artificial
  20-mer unique DNA sequence
tcccccgccttttattcgct

SEQ ID NO: 5816 - DNA, 20 bp, Artificial
  20-mer unique DNA sequence
gccttgaggagcacgctggt

SEQ ID NO: 5817 - DNA, 20 bp, Artificial
  20-mer unique DNA sequence
cactcacgacggccgaaagg

SEQ ID NO: 5818 - DNA, 20 bp, Artificial
  20-mer unique DNA sequence
ggtaggcggtgcggagaggg

SEQ ID NO: 5819 - DNA, 20 bp, Artificial
  20-mer unique DNA sequence
ataagcccgcacacagccgc

SEQ ID NO: 5820 - DNA, 20 bp, Artificial
  20-mer unique DNA sequence
cacgctcgcctcctttccag

SEQ ID NO: 5821 - DNA, 20 bp, Artificial
  20-mer unique DNA sequence
tcgcctgtcggtttctcgcg

SEQ ID NO: 5822 - DNA, 20 bp, Artificial
  20-mer unique DNA sequence
ggcccccggtattgagtgtg

SEQ ID NO: 5823 - DNA, 20 bp, Artificial
  20-mer unique DNA sequence
cagctgttcttgcggatggg

SEQ ID NO: 5824 - DNA, 20 bp, Artificial
  20-mer unique DNA sequence
tcaggcttcaggcgtcacgt

SEQ ID NO: 5825 - DNA, 20 bp, Artificial
  20-mer unique DNA sequence
tgggcgcaagcacggaatac

SEQ ID NO: 5826 - DNA, 20 bp, Artificial
  20-mer unique DNA sequence
gcactttccggagcgtcaca

SEQ ID NO: 5827 - DNA, 20 bp, Artificial
  20-mer unique DNA sequence
tgcaagccatacaccgacgc

SEQ ID NO: 5828 - DNA, 20 bp, Artificial
  20-mer unique DNA sequence
gtgcatggcctggagcgtgg

SEQ ID NO: 5829 - DNA, 20 bp, Artificial
  20-mer unique DNA sequence
ttcggttaagccacaggcgc

SEQ ID NO: 5830 - DNA, 20 bp, Artificial
  20-mer unique DNA sequence
gccccagccgatacctaccc

SEQ ID NO: 5831 - DNA, 20 bp, Artificial
  20-mer unique DNA sequence
ccataaggaaacggggcgaa

SEQ ID NO: 5832 - DNA, 20 bp, Artificial
  20-mer unique DNA sequence
ccgccaagccacgtatctcc

SEQ ID NO: 5833 - DNA, 20 bp, Artificial
  20-mer unique DNA sequence
ctagcgcaggccccattcat

SEQ ID NO: 5834 - DNA, 20 bp, Artificial
  20-mer unique DNA sequence
tgcctgcgagtgtggttcct

SEQ ID NO: 5835 - DNA, 20 bp, Artificial
  20-mer unique DNA sequence
tataaccgtccccccccatg

SEQ ID NO: 5836 - DNA, 20 bp, Artificial
  20-mer unique DNA sequence
gaacccatcggcaaccccac

SEQ ID NO: 5837 - DNA, 20 bp, Artificial
  20-mer unique DNA sequence
gtcccgccgctcccgaacta

SEQ ID NO: 5838 - DNA, 20 bp, Artificial
  20-mer unique DNA sequence
agcccagttaccgcccacgc

SEQ ID NO: 5839 - DNA, 20 bp, Artificial
  20-mer unique DNA sequence
tgacccgcctttcagtgtgc

SEQ ID NO: 5840 - DNA, 20 bp, Artificial
  20-mer unique DNA sequence
aggcaacaagtgggtggggc

SEQ ID NO: 5841 - DNA, 20 bp, Artificial
  20-mer unique DNA sequence
gcagccaacaaccagccctc

SEQ ID NO: 5842 - DNA, 20 bp, Artificial
  20-mer unique DNA sequence
agggacaactgcatggcggg

SEQ ID NO: 5843 - DNA, 20 bp, Artificial
  20-mer unique DNA sequence
gagcgctgccaaagggaaag

SEQ ID NO: 5844 - DNA, 20 bp, Artificial
  20-mer unique DNA sequence
ccgactccatgaaaaggccg

SEQ ID NO: 5845 - DNA, 20 bp, Artificial
  20-mer unique DNA sequence
gcctctcccgacattcctgc

SEQ ID NO: 5846 - DNA, 20 bp, Artificial
  20-mer unique DNA sequence
tttttactgggcggcggtgg

SEQ ID NO: 5847 - DNA, 20 bp, Artificial
  20-mer unique DNA sequence
ttcagccatggtttcggggt

SEQ ID NO: 5848 - DNA, 20 bp, Artificial
  20-mer unique DNA sequence
taaatgatggcgccgtggtc

SEQ ID NO: 5849 - DNA, 20 bp, Artificial
  20-mer unique DNA sequence
agggtgcggaatgtggggag

SEQ ID NO: 5850 - DNA, 20 bp, Artificial
  20-mer unique DNA sequence
tactcctgcggctttgggcg

SEQ ID NO: 5851 - DNA, 20 bp, Artificial
  20-mer unique DNA sequence
taatgccaaagcccgccgaa

SEQ ID NO: 5852 - DNA, 20 bp, Artificial
  20-mer unique DNA sequence
ctcggcgttgcccacattca

SEQ ID NO: 5853 - DNA, 20 bp, Artificial
  20-mer unique DNA sequence
cgcattcgccagcaggtctg

SEQ ID NO: 5854 - DNA, 20 bp, Artificial
  20-mer unique DNA sequence
catcactccaacaccgcgcc

SEQ ID NO: 5855 - DNA, 20 bp, Artificial
  20-mer unique DNA sequence
tggaacggggtgcaatctcg

SEQ ID NO: 5856 - DNA, 20 bp, Artificial
  20-mer unique DNA sequence
tagcagacgcccagaacgcc

SEQ ID NO: 5857 - DNA, 20 bp, Artificial
  20-mer unique DNA sequence
aaacgagccgccaccctggt

SEQ ID NO: 5858 - DNA, 20 bp, Artificial
  20-mer unique DNA sequence
attccagccacctcccccca

SEQ ID NO: 5859 - DNA, 20 bp, Artificial
  20-mer unique DNA sequence
ggctcgggcagagggtaggc

SEQ ID NO: 5860 - DNA, 20 bp, Artificial
  20-mer unique DNA sequence
tacagcgctccggattccct

SEQ ID NO: 5861 - DNA, 20 bp, Artificial
  20-mer unique DNA sequence
tccgcccgctcataatcccc

SEQ ID NO: 5862 - DNA, 20 bp, Artificial
  20-mer unique DNA sequence
agcggggggcttttatgttg

SEQ ID NO: 5863 - DNA, 20 bp, Artificial
  20-mer unique DNA sequence
atgggcgagacgaggacggt

SEQ ID NO: 5864 - DNA, 20 bp, Artificial
  20-mer unique DNA sequence
aggccctaagcaccggaacg

SEQ ID NO: 5865 - DNA, 20 bp, Artificial
  20-mer unique DNA sequence
cctgctcatgccccaaatca

SEQ ID NO: 5866 - DNA, 20 bp, Artificial
  20-mer unique DNA sequence
cccgtatgcccaccgcctct

SEQ ID NO: 5867 - DNA, 20 bp, Artificial
  20-mer unique DNA sequence
gcaagaagacgcggcaatcc

SEQ ID NO: 5868 - DNA, 20 bp, Artificial
  20-mer unique DNA sequence
cgggtgagggtgaaagcgag

SEQ ID NO: 5869 - DNA, 20 bp, Artificial
  20-mer unique DNA sequence
actgtttggctgcgtgtcga

SEQ ID NO: 5870 - DNA, 20 bp, Artificial
  20-mer unique DNA sequence
ggccccacttcaccatcgca

SEQ ID NO: 5871 - DNA, 20 bp, Artificial
  20-mer unique DNA sequence
gcgactagcggtgccagatt

SEQ ID NO: 5872 - DNA, 20 bp, Artificial
  20-mer unique DNA sequence
gtcaccgcggcttcccaatt

SEQ ID NO: 5873 - DNA, 20 bp, Artificial
  20-mer unique DNA sequence
atccgggcacgcaaaggtac

SEQ ID NO: 5874 - DNA, 20 bp, Artificial
  20-mer unique DNA sequence
ggctgatatgctccgctgca

SEQ ID NO: 5875 - DNA, 20 bp, Artificial
  20-mer unique DNA sequence
acgagacgacaaccctgccc

SEQ ID NO: 5876 - DNA, 20 bp, Artificial
  20-mer unique DNA sequence
gttgaacgcggggtgaaagc

SEQ ID NO: 5877 - DNA, 20 bp, Artificial
  20-mer unique DNA sequence
tcggcttgagggtgcgtcta

SEQ ID NO: 5878 - DNA, 20 bp, Artificial
  20-mer unique DNA sequence
cgcggacctcatgaattggc

SEQ ID NO: 5879 - DNA, 20 bp, Artificial
  20-mer unique DNA sequence
cttggaggttggcccgctga

SEQ ID NO: 5880 - DNA, 20 bp, Artificial
  20-mer unique DNA sequence
cataaaacatcccgggcgcg

SEQ ID NO: 5881 - DNA, 20 bp, Artificial
  20-mer unique DNA sequence
cgatgcacgaaaccccgaga

SEQ ID NO: 5882 - DNA, 20 bp, Artificial
  20-mer unique DNA sequence
ccaaacggcaaggggaacga

SEQ ID NO: 5883 - DNA, 20 bp, Artificial
  20-mer unique DNA sequence
gtggtggcgaagggaagggt

SEQ ID NO: 5884 - DNA, 20 bp, Artificial
  20-mer unique DNA sequence
ctacggcgaccaacgggacg

SEQ ID NO: 5885 - DNA, 20 bp, Artificial
  20-mer unique DNA sequence
agacccggcattccagcagg

SEQ ID NO: 5886 - DNA, 20 bp, Artificial
  20-mer unique DNA sequence
ggccttcgctctgccttgca

SEQ ID NO: 5887 - DNA, 20 bp, Artificial
  20-mer unique DNA sequence
aattgaactgagccgcgcgc

SEQ ID NO: 5888 - DNA, 20 bp, Artificial
  20-mer unique DNA sequence
gaaaggcccgaacgcgaatt

SEQ ID NO: 5889 - DNA, 20 bp, Artificial
  20-mer unique DNA sequence
ccccctgcggcaatcaaatg

SEQ ID NO: 5890 - DNA, 20 bp, Artificial
  20-mer unique DNA sequence
tgcgtgggtggggaaaacag

SEQ ID NO: 5891 - DNA, 20 bp, Artificial
  20-mer unique DNA sequence
ccccaaacctagcgccaacc

SEQ ID NO: 5892 - DNA, 20 bp, Artificial
  20-mer unique DNA sequence
acgcttacccgcccgatgtg

SEQ ID NO: 5893 - DNA, 20 bp, Artificial
  20-mer unique DNA sequence
gccgccaacctagcaaaccc

SEQ ID NO: 5894 - DNA, 20 bp, Artificial
  20-mer unique DNA sequence
ggacacggaagggcgagaaa

SEQ ID NO: 5895 - DNA, 20 bp, Artificial
  20-mer unique DNA sequence
ccgttccttgccacccattt

SEQ ID NO: 5896 - DNA, 20 bp, Artificial
  20-mer unique DNA sequence
ccaagtgcgcgagtacaggg

SEQ ID NO: 5897 - DNA, 20 bp, Artificial
  20-mer unique DNA sequence
cccgtcgcctcgcagacatc

SEQ ID NO: 5898 - DNA, 20 bp, Artificial
  20-mer unique DNA sequence
agccattcacacgcggtcag

SEQ ID NO: 5899 - DNA, 20 bp, Artificial
  20-mer unique DNA sequence
gtcgtatttggcgccgtggg

SEQ ID NO: 5900 - DNA, 20 bp, Artificial
  20-mer unique DNA sequence
gtagagcgtggggcgaatgg

SEQ ID NO: 5901 - DNA, 20 bp, Artificial
  20-mer unique DNA sequence
acaatgaacgccagggggaa

SEQ ID NO: 5902 - DNA, 20 bp, Artificial
  20-mer unique DNA sequence
tcgtttctgggcgtgctggt

SEQ ID NO: 5903 - DNA, 20 bp, Artificial
  20-mer unique DNA sequence
agcgaacgagaaccccaccg

SEQ ID NO: 5904 - DNA, 20 bp, Artificial
  20-mer unique DNA sequence
ttacaacgcatgggacgggg

SEQ ID NO: 5905 - DNA, 20 bp, Artificial
  20-mer unique DNA sequence
gcgaagtagcagaacccggg

SEQ ID NO: 5906 - DNA, 20 bp, Artificial
  20-mer unique DNA sequence
ggttaggggcgggagagctg

SEQ ID NO: 5907 - DNA, 20 bp, Artificial
  20-mer unique DNA sequence
agcccgtctggccatgttca

SEQ ID NO: 5908 - DNA, 20 bp, Artificial
  20-mer unique DNA sequence
aaacaaatggcgccgtcgaa

SEQ ID NO: 5909 - DNA, 20 bp, Artificial
  20-mer unique DNA sequence
gattggcctattcgcaccgc

SEQ ID NO: 5910 - DNA, 20 bp, Artificial
  20-mer unique DNA sequence
tcaattgtgaggcggcgaac

SEQ ID NO: 5911 - DNA, 20 bp, Artificial
  20-mer unique DNA sequence
gcgagatgaagcgggaatgg

SEQ ID NO: 5912 - DNA, 20 bp, Artificial
  20-mer unique DNA sequence
acgggggggcgacttcctat

SEQ ID NO: 5913 - DNA, 20 bp, Artificial
  20-mer unique DNA sequence
cgagcgaaccttggagtggt

SEQ ID NO: 5914 - DNA, 20 bp, Artificial
  20-mer unique DNA sequence
gctactgcctgaccctgccg

SEQ ID NO: 5915 - DNA, 20 bp, Artificial
  20-mer unique DNA sequence
gggggttttcgctgtctgca

SEQ ID NO: 5916 - DNA, 20 bp, Artificial
  20-mer unique DNA sequence
aggggggaatcgtaggagcg

SEQ ID NO: 5917 - DNA, 20 bp, Artificial
  20-mer unique DNA sequence
gttcccctgcctcttgctgc

SEQ ID NO: 5918 - DNA, 20 bp, Artificial
  20-mer unique DNA sequence
agtagccactccacgcgcgc

SEQ ID NO: 5919 - DNA, 20 bp, Artificial
  20-mer unique DNA sequence
taccgcttcccgggttcctc

SEQ ID NO: 5920 - DNA, 20 bp, Artificial
  20-mer unique DNA sequence
cccttcgataccaccgccac

SEQ ID NO: 5921 - DNA, 20 bp, Artificial
  20-mer unique DNA sequence
ccgccgatgtgagtgattgc

SEQ ID NO: 5922 - DNA, 20 bp, Artificial
  20-mer unique DNA sequence
cagggcgcaagtggggtgtc

SEQ ID NO: 5923 - DNA, 20 bp, Artificial
  20-mer unique DNA sequence
accccaccgcgttcatgcag

SEQ ID NO: 5924 - DNA, 20 bp, Artificial
  20-mer unique DNA sequence
cgggccgcaacccttgatct

SEQ ID NO: 5925 - DNA, 20 bp, Artificial
  20-mer unique DNA sequence
tgttatgcggcacgacggac

SEQ ID NO: 5926 - DNA, 20 bp, Artificial
  20-mer unique DNA sequence
ggctgtgggcgaggagggag

SEQ ID NO: 5927 - DNA, 20 bp, Artificial
  20-mer unique DNA sequence
agaatcccggcgccatacag

SEQ ID NO: 5928 - DNA, 20 bp, Artificial
  20-mer unique DNA sequence
ccgtcgtttccctaacccca

SEQ ID NO: 5929 - DNA, 20 bp, Artificial
  20-mer unique DNA sequence
tttcccgacttcctgcccaa

SEQ ID NO: 5930 - DNA, 20 bp, Artificial
  20-mer unique DNA sequence
gatgatgttcggccggtggt

SEQ ID NO: 5931 - DNA, 20 bp, Artificial
  20-mer unique DNA sequence
ttgtgttttgaaggcgccga

SEQ ID NO: 5932 - DNA, 20 bp, Artificial
  20-mer unique DNA sequence
catctacgcccaacccgctg

SEQ ID NO: 5933 - DNA, 20 bp, Artificial
  20-mer unique DNA sequence
gcgaaagacgagaggctggg

SEQ ID NO: 5934 - DNA, 20 bp, Artificial
  20-mer unique DNA sequence
ggtctccgccgcctccttac

SEQ ID NO: 5935 - DNA, 20 bp, Artificial
  20-mer unique DNA sequence
ccgagacgaaatgacgcgca

SEQ ID NO: 5936 - DNA, 20 bp, Artificial
  20-mer unique DNA sequence
accaaggccgcaccgatgat

SEQ ID NO: 5937 - DNA, 20 bp, Artificial
  20-mer unique DNA sequence
gctgccttacgcgggattgg

SEQ ID NO: 5938 - DNA, 20 bp, Artificial
  20-mer unique DNA sequence
taatggtcttggaggtggcg

SEQ ID NO: 5939 - DNA, 20 bp, Artificial
  20-mer unique DNA sequence
acagggaccgatgagaggcg

SEQ ID NO: 5940 - DNA, 20 bp, Artificial
  20-mer unique DNA sequence
cggatccggactcgctcatt

SEQ ID NO: 5941 - DNA, 20 bp, Artificial
  20-mer unique DNA sequence
tgagctcgaccgcactaggt

SEQ ID NO: 5942 - DNA, 20 bp, Artificial
  20-mer unique DNA sequence
gcagcagtacgggccaacaa

SEQ ID NO: 5943 - DNA, 20 bp, Artificial
  20-mer unique DNA sequence
tcgcggtggtgcaaaggaaa

SEQ ID NO: 5944 - DNA, 20 bp, Artificial
  20-mer unique DNA sequence
ctttctccgcttgcccgttc

SEQ ID NO: 5945 - DNA, 20 bp, Artificial
  20-mer unique DNA sequence
ggacgggcaggggaaagaca

SEQ ID NO: 5946 - DNA, 20 bp, Artificial
  20-mer unique DNA sequence
gcacgcccacgaaaaggaaa

SEQ ID NO: 5947 - DNA, 20 bp, Artificial
  20-mer unique DNA sequence
aggcactggcgggtatttgg

SEQ ID NO: 5948 - DNA, 20 bp, Artificial
  20-mer unique DNA sequence
gtgcgtttggaccctgtggc

SEQ ID NO: 5949 - DNA, 20 bp, Artificial
  20-mer unique DNA sequence
tcgttccggcggtttactcc

SEQ ID NO: 5950 - DNA, 20 bp, Artificial
  20-mer unique DNA sequence
gcggttggctgctttgatga

SEQ ID NO: 5951 - DNA, 20 bp, Artificial
  20-mer unique DNA sequence
cccgccgtcttgctgctatt

SEQ ID NO: 5952 - DNA, 20 bp, Artificial
  20-mer unique DNA sequence
acacccagtccaggcccagc

SEQ ID NO: 5953 - DNA, 20 bp, Artificial
  20-mer unique DNA sequence
tgcggtcgggtaatgcctct

SEQ ID NO: 5954 - DNA, 20 bp, Artificial
  20-mer unique DNA sequence
acggcaccacgatacggcaa

SEQ ID NO: 5955 - DNA, 20 bp, Artificial
  20-mer unique DNA sequence
aatgatgtgtcggcggcgat

SEQ ID NO: 5956 - DNA, 20 bp, Artificial
  20-mer unique DNA sequence
cattcctcgtgctttccccg

SEQ ID NO: 5957 - DNA, 20 bp, Artificial
  20-mer unique DNA sequence
catggcaaagtcgggaagcg

SEQ ID NO: 5958 - DNA, 20 bp, Artificial
  20-mer unique DNA sequence
gggcgtaggcacttcttggc

SEQ ID NO: 5959 - DNA, 20 bp, Artificial
  20-mer unique DNA sequence
ttgtttcggggatcgctacc

SEQ ID NO: 5960 - DNA, 20 bp, Artificial
  20-mer unique DNA sequence
tcatgacacgtcgcgcggta

SEQ ID NO: 5961 - DNA, 20 bp, Artificial
  20-mer unique DNA sequence
tgcgtgccacgtcatcgaat

SEQ ID NO: 5962 - DNA, 20 bp, Artificial
  20-mer unique DNA sequence
ggaccacgccaacgacctga

SEQ ID NO: 5963 - DNA, 20 bp, Artificial
  20-mer unique DNA sequence
catgggtttcaggtcgcgct

SEQ ID NO: 5964 - DNA, 20 bp, Artificial
  20-mer unique DNA sequence
cccacccaacgccattccac

SEQ ID NO: 5965 - DNA, 20 bp, Artificial
  20-mer unique DNA sequence
gtgcgttactgttgccggcg

SEQ ID NO: 5966 - DNA, 20 bp, Artificial
  20-mer unique DNA sequence
cggggacacaggggatgagg

SEQ ID NO: 5967 - DNA, 20 bp, Artificial
  20-mer unique DNA sequence
ttcacccccgagccgtttgt

SEQ ID NO: 5968 - DNA, 20 bp, Artificial
  20-mer unique DNA sequence
ttccgtaaggtccagccggg

SEQ ID NO: 5969 - DNA, 20 bp, Artificial
  20-mer unique DNA sequence
cgcgggaagctgtagtgggg

SEQ ID NO: 5970 - DNA, 20 bp, Artificial
  20-mer unique DNA sequence
agtgctctgccgcgttggtc

SEQ ID NO: 5971 - DNA, 20 bp, Artificial
  20-mer unique DNA sequence
tgatattgcgcaggacgggg

SEQ ID NO: 5972 - DNA, 20 bp, Artificial
  20-mer unique DNA sequence
agaatggaaacgtgcgcccc

SEQ ID NO: 5973 - DNA, 20 bp, Artificial
  20-mer unique DNA sequence
tccaccccgcgctcaatcta

SEQ ID NO: 5974 - DNA, 20 bp, Artificial
  20-mer unique DNA sequence
ttgcccgctgtcctccttgc

SEQ ID NO: 5975 - DNA, 20 bp, Artificial
  20-mer unique DNA sequence
cggtggtcgcggtgaatctt

SEQ ID NO: 5976 - DNA, 20 bp, Artificial
  20-mer unique DNA sequence
cgacgccaccatacctgaaa

SEQ ID NO: 5977 - DNA, 20 bp, Artificial
  20-mer unique DNA sequence
atacccgcctaccgaccgca

SEQ ID NO: 5978 - DNA, 20 bp, Artificial
  20-mer unique DNA sequence
ccggagccacagggacagct

SEQ ID NO: 5979 - DNA, 20 bp, Artificial
  20-mer unique DNA sequence
catgcagtcggtgggagggc

SEQ ID NO: 5980 - DNA, 20 bp, Artificial
  20-mer unique DNA sequence
attcataaccgcgggacgct

SEQ ID NO: 5981 - DNA, 20 bp, Artificial
  20-mer unique DNA sequence
acgcctgctttgtgaccgac

SEQ ID NO: 5982 - DNA, 20 bp, Artificial
  20-mer unique DNA sequence
ttccctgccaacgacactgc

SEQ ID NO: 5983 - DNA, 20 bp, Artificial
  20-mer unique DNA sequence
cccccaggcatcacatcacc

SEQ ID NO: 5984 - DNA, 20 bp, Artificial
  20-mer unique DNA sequence
accatgcgaaacggccaact

SEQ ID NO: 5985 - DNA, 20 bp, Artificial
  20-mer unique DNA sequence
gtcatagaagggcctgcgcc

SEQ ID NO: 5986 - DNA, 20 bp, Artificial
  20-mer unique DNA sequence
gttcaaaagagggcgggggc

SEQ ID NO: 5987 - DNA, 20 bp, Artificial
  20-mer unique DNA sequence
tttgaggcgcggatggttga

SEQ ID NO: 5988 - DNA, 20 bp, Artificial
  20-mer unique DNA sequence
ccaataccgttccgcctcgt

SEQ ID NO: 5989 - DNA, 20 bp, Artificial
  20-mer unique DNA sequence
tgacgggagcaaggcgatga

SEQ ID NO: 5990 - DNA, 20 bp, Artificial
  20-mer unique DNA sequence
tcagaaatcgcgaggggggt

SEQ ID NO: 5991 - DNA, 20 bp, Artificial
  20-mer unique DNA sequence
agatttcgcagacgcccggg

SEQ ID NO: 5992 - DNA, 20 bp, Artificial
  20-mer unique DNA sequence
agagcggtgcgggtattcga

SEQ ID NO: 5993 - DNA, 20 bp, Artificial
  20-mer unique DNA sequence
catgcgttgccgttcctttg

SEQ ID NO: 5994 - DNA, 20 bp, Artificial
  20-mer unique DNA sequence
ggtagtttgtcccgcccgtc

SEQ ID NO: 5995 - DNA, 20 bp, Artificial
  20-mer unique DNA sequence
tggtgttggacggatggctg

SEQ ID NO: 5996 - DNA, 20 bp, Artificial
  20-mer unique DNA sequence
aggcgcgtggagtgaattgc

SEQ ID NO: 5997 - DNA, 20 bp, Artificial
  20-mer unique DNA sequence
ggtccggaatgcgcaaaagc

SEQ ID NO: 5998 - DNA, 20 bp, Artificial
  20-mer unique DNA sequence
cgaccatactccccgctccc

SEQ ID NO: 5999 - DNA, 20 bp, Artificial
  20-mer unique DNA sequence
gccccaaaacgttccagcac

SEQ ID NO: 6000 - DNA, 20 bp, Artificial
  20-mer unique DNA sequence
ggggagtcgcatcacaggga

SEQ ID NO: 6001 - DNA, 20 bp, Artificial
  20-mer unique DNA sequence
taacgtagcggcgagagcca

SEQ ID NO: 6002 - DNA, 20 bp, Artificial
  20-mer unique DNA sequence
tgtgggctgctggggtcaaa

SEQ ID NO: 6003 - DNA, 20 bp, Artificial
  20-mer unique DNA sequence
cccgcggagattaggttggc

SEQ ID NO: 6004 - DNA, 20 bp, Artificial
  20-mer unique DNA sequence
acaccctgccccctcttcaa

SEQ ID NO: 6005 - DNA, 20 bp, Artificial
  20-mer unique DNA sequence
gctccgcctcgcccatccta

SEQ ID NO: 6006 - DNA, 20 bp, Artificial
  20-mer unique DNA sequence
gcctatgatcgcgcgctttg

SEQ ID NO: 6007 - DNA, 20 bp, Artificial
  20-mer unique DNA sequence
gaagtatccgcgacgcctcg

SEQ ID NO: 6008 - DNA, 20 bp, Artificial
  20-mer unique DNA sequence
gcgccgtccgaagtaccatg

SEQ ID NO: 6009 - DNA, 20 bp, Artificial
  20-mer unique DNA sequence
gcgcctccctcttgttcgaa

SEQ ID NO: 6010 - DNA, 20 bp, Artificial
  20-mer unique DNA sequence
caagggttttgtgcggggga

SEQ ID NO: 6011 - DNA, 20 bp, Artificial
  20-mer unique DNA sequence
gtgagcggagggggcactgt

SEQ ID NO: 6012 - DNA, 20 bp, Artificial
  20-mer unique DNA sequence
cgacaatcgaactccgcggc

SEQ ID NO: 6013 - DNA, 20 bp, Artificial
  20-mer unique DNA sequence
cggggacgatcgtaggctgc

SEQ ID NO: 6014 - DNA, 20 bp, Artificial
  20-mer unique DNA sequence
ggcagggggctacattcggt

SEQ ID NO: 6015 - DNA, 20 bp, Artificial
  20-mer unique DNA sequence
cggttgctcgctgtttcgct

SEQ ID NO: 6016 - DNA, 20 bp, Artificial
  20-mer unique DNA sequence
gagcgcggtgacaggtattg

SEQ ID NO: 6017 - DNA, 20 bp, Artificial
  20-mer unique DNA sequence
aggggagggagagctgcgga

SEQ ID NO: 6018 - DNA, 20 bp, Artificial
  20-mer unique DNA sequence
gatatttccgcccgccgacc

SEQ ID NO: 6019 - DNA, 20 bp, Artificial
  20-mer unique DNA sequence
aatgaatggtcggcacggga

SEQ ID NO: 6020 - DNA, 20 bp, Artificial
  20-mer unique DNA sequence
aatgccgttcccctgtcctg

SEQ ID NO: 6021 - DNA, 20 bp, Artificial
  20-mer unique DNA sequence
gccgtactacagggtcgcaa

SEQ ID NO: 6022 - DNA, 20 bp, Artificial
  20-mer unique DNA sequence
taaccgaaccgcctcacgct

SEQ ID NO: 6023 - DNA, 20 bp, Artificial
  20-mer unique DNA sequence
acctcgttagggccgatcca

SEQ ID NO: 6024 - DNA, 20 bp, Artificial
  20-mer unique DNA sequence
ccccccaggcatccgtcatt

SEQ ID NO: 6025 - DNA, 20 bp, Artificial
  20-mer unique DNA sequence
atggaagcggcgagcaaagc

SEQ ID NO: 6026 - DNA, 20 bp, Artificial
  20-mer unique DNA sequence
gggcggcttaacttggggca

SEQ ID NO: 6027 - DNA, 20 bp, Artificial
  20-mer unique DNA sequence
gatcggggcctgggtgtggt

SEQ ID NO: 6028 - DNA, 20 bp, Artificial
  20-mer unique DNA sequence
cccgagccgccatagacctt

SEQ ID NO: 6029 - DNA, 20 bp, Artificial
  20-mer unique DNA sequence
aatccccgtgtcctctcccc

SEQ ID NO: 6030 - DNA, 20 bp, Artificial
  20-mer unique DNA sequence
cagcccgtcgaacagcccag

SEQ ID NO: 6031 - DNA, 20 bp, Artificial
  20-mer unique DNA sequence
tcagccgagccgcacataag

SEQ ID NO: 6032 - DNA, 20 bp, Artificial
  20-mer unique DNA sequence
aagtggggtcgcgtatggga

SEQ ID NO: 6033 - DNA, 20 bp, Artificial
  20-mer unique DNA sequence
gagaattgggggtccgagcg

SEQ ID NO: 6034 - DNA, 20 bp, Artificial
  20-mer unique DNA sequence
gcggcagagaggcggaagag

SEQ ID NO: 6035 - DNA, 20 bp, Artificial
  20-mer unique DNA sequence
agaccgcccaaaccccaagg

SEQ ID NO: 6036 - DNA, 20 bp, Artificial
  20-mer unique DNA sequence
ccttgcaaaaacccggggaa

SEQ ID NO: 6037 - DNA, 20 bp, Artificial
  20-mer unique DNA sequence
cggggggaagtgacgggctc

SEQ ID NO: 6038 - DNA, 20 bp, Artificial
  20-mer unique DNA sequence
tacagacccgcccttccgtg

SEQ ID NO: 6039 - DNA, 20 bp, Artificial
  20-mer unique DNA sequence
tgggaggttgttggcgtgag

SEQ ID NO: 6040 - DNA, 20 bp, Artificial
  20-mer unique DNA sequence
gcagcaaagccgactacccg

SEQ ID NO: 6041 - DNA, 20 bp, Artificial
  20-mer unique DNA sequence
tcgcctcggtatctttcgcc

SEQ ID NO: 6042 - DNA, 20 bp, Artificial
  20-mer unique DNA sequence
cgttccccatccccatccac

SEQ ID NO: 6043 - DNA, 20 bp, Artificial
  20-mer unique DNA sequence
tcctgcccgaccttttgtgc

SEQ ID NO: 6044 - DNA, 20 bp, Artificial
  20-mer unique DNA sequence
cgccgagcagagtttcaccc

SEQ ID NO: 6045 - DNA, 20 bp, Artificial
  20-mer unique DNA sequence
aggccggctcccaacaagac

SEQ ID NO: 6046 - DNA, 20 bp, Artificial
  20-mer unique DNA sequence
tactcgccaccacgcccatt

SEQ ID NO: 6047 - DNA, 20 bp, Artificial
  20-mer unique DNA sequence
ccaccccgtcacacgcaata

SEQ ID NO: 6048 - DNA, 20 bp, Artificial
  20-mer unique DNA sequence
gagcagggaatttgacgggg

SEQ ID NO: 6049 - DNA, 20 bp, Artificial
  20-mer unique DNA sequence
aacgccaatagccaccctgc

SEQ ID NO: 6050 - DNA, 20 bp, Artificial
  20-mer unique DNA sequence
tcatgtccaccccgtcccac

SEQ ID NO: 6051 - DNA, 20 bp, Artificial
  20-mer unique DNA sequence
caccctcacctcgcctccat

SEQ ID NO: 6052 - DNA, 20 bp, Artificial
  20-mer unique DNA sequence
agcagggcaacagctaagga

SEQ ID NO: 6053 - DNA, 20 bp, Artificial
  20-mer unique DNA sequence
tcgcttccgtcctcccctct

SEQ ID NO: 6054 - DNA, 20 bp, Artificial
  20-mer unique DNA sequence
tcacaagcggcaacctacgg

SEQ ID NO: 6055 - DNA, 20 bp, Artificial
  20-mer unique DNA sequence
accggacagcccaacaacgt

SEQ ID NO: 6056 - DNA, 20 bp, Artificial
  20-mer unique DNA sequence
ccggctgcgctccctttctt

SEQ ID NO: 6057 - DNA, 20 bp, Artificial
  20-mer unique DNA sequence
cctcccatccctccccacgt

SEQ ID NO: 6058 - DNA, 20 bp, Artificial
  20-mer unique DNA sequence
accgccccccagcaataagc

SEQ ID NO: 6059 - DNA, 20 bp, Artificial
  20-mer unique DNA sequence
tgggacagggcggagtagca

SEQ ID NO: 6060 - DNA, 20 bp, Artificial
  20-mer unique DNA sequence
accgtgggcgggtgaacatt

SEQ ID NO: 6061 - DNA, 20 bp, Artificial
  20-mer unique DNA sequence
tcacacctcaccccgttcgc

SEQ ID NO: 6062 - DNA, 20 bp, Artificial
  20-mer unique DNA sequence
acaggaaggaccgcgtgcag

SEQ ID NO: 6063 - DNA, 20 bp, Artificial
  20-mer unique DNA sequence
ccgctgcctaagtaagcccg

SEQ ID NO: 6064 - DNA, 20 bp, Artificial
  20-mer unique DNA sequence
tgcggaaaactacggggcag

SEQ ID NO: 6065 - DNA, 20 bp, Artificial
  20-mer unique DNA sequence
tttcggctcttgcgtccctc

SEQ ID NO: 6066 - DNA, 20 bp, Artificial
  20-mer unique DNA sequence
ctgtctatgcggaggtggcg

SEQ ID NO: 6067 - DNA, 20 bp, Artificial
  20-mer unique DNA sequence
ctccgtcgctcgtgcttgtg

SEQ ID NO: 6068 - DNA, 20 bp, Artificial
  20-mer unique DNA sequence
ggggttcactagtcgggggg

SEQ ID NO: 6069 - DNA, 20 bp, Artificial
  20-mer unique DNA sequence
cgctccccgcctttacccta

SEQ ID NO: 6070 - DNA, 20 bp, Artificial
  20-mer unique DNA sequence
gacggtgtgcgggatatcgg

SEQ ID NO: 6071 - DNA, 20 bp, Artificial
  20-mer unique DNA sequence
aaaccaacgcggaggaagcc

SEQ ID NO: 6072 - DNA, 20 bp, Artificial
  20-mer unique DNA sequence
cctagcatcccaaacgcgca

SEQ ID NO: 6073 - DNA, 20 bp, Artificial
  20-mer unique DNA sequence
attaaacccggccgcgacca

SEQ ID NO: 6074 - DNA, 20 bp, Artificial
  20-mer unique DNA sequence
aataatgcgccaagccccac

SEQ ID NO: 6075 - DNA, 20 bp, Artificial
  20-mer unique DNA sequence
tacttcccctgcttcgccca

SEQ ID NO: 6076 - DNA, 20 bp, Artificial
  20-mer unique DNA sequence
tagcccccgcctccgacaat

SEQ ID NO: 6077 - DNA, 20 bp, Artificial
  20-mer unique DNA sequence
aggttgagagcaaggggggg

SEQ ID NO: 6078 - DNA, 20 bp, Artificial
  20-mer unique DNA sequence
accaacggacaagccccact

SEQ ID NO: 6079 - DNA, 20 bp, Artificial
  20-mer unique DNA sequence
ccaatattctcgcgcgtgcc

SEQ ID NO: 6080 - DNA, 20 bp, Artificial
  20-mer unique DNA sequence
gtctggggcctcggcttttg

SEQ ID NO: 6081 - DNA, 20 bp, Artificial
  20-mer unique DNA sequence
tatgaccctgactccgcgcg

SEQ ID NO: 6082 - DNA, 20 bp, Artificial
  20-mer unique DNA sequence
tgacagccaactccagcgcc

SEQ ID NO: 6083 - DNA, 20 bp, Artificial
  20-mer unique DNA sequence
cttgtccactgactggcgcg

SEQ ID NO: 6084 - DNA, 20 bp, Artificial
  20-mer unique DNA sequence
tggttgtggtgcgaagaggg

SEQ ID NO: 6085 - DNA, 20 bp, Artificial
  20-mer unique DNA sequence
cgcctcagcccctttcctcg

SEQ ID NO: 6086 - DNA, 20 bp, Artificial
  20-mer unique DNA sequence
tcaatgtggggcgcggatag

SEQ ID NO: 6087 - DNA, 20 bp, Artificial
  20-mer unique DNA sequence
acctcgccgcaatgaaacgc

SEQ ID NO: 6088 - DNA, 20 bp, Artificial
  20-mer unique DNA sequence
tcccgcatcgcccttacaca

SEQ ID NO: 6089 - DNA, 20 bp, Artificial
  20-mer unique DNA sequence
tgcgggttggcttatgtggc

SEQ ID NO: 6090 - DNA, 20 bp, Artificial
  20-mer unique DNA sequence
actcgtacagtcgacgctcg

SEQ ID NO: 6091 - DNA, 20 bp, Artificial
  20-mer unique DNA sequence
aaaccgcagtgagacgcgaa

SEQ ID NO: 6092 - DNA, 20 bp, Artificial
  20-mer unique DNA sequence
ggcggggaaggagcaaaacg

SEQ ID NO: 6093 - DNA, 20 bp, Artificial
  20-mer unique DNA sequence
gactggcgaggcgaagacgg

SEQ ID NO: 6094 - DNA, 20 bp, Artificial
  20-mer unique DNA sequence
aggacacggccgacagacag

SEQ ID NO: 6095 - DNA, 20 bp, Artificial
  20-mer unique DNA sequence
tcctggcttgtgtggcgtgc

SEQ ID NO: 6096 - DNA, 20 bp, Artificial
  20-mer unique DNA sequence
acacaacgccccgaacctct

SEQ ID NO: 6097 - DNA, 20 bp, Artificial
  20-mer unique DNA sequence
cgctcccactccgcccaaat

SEQ ID NO: 6098 - DNA, 20 bp, Artificial
  20-mer unique DNA sequence
ccggtggtctgtgcatggct

SEQ ID NO: 6099 - DNA, 20 bp, Artificial
  20-mer unique DNA sequence
cggggctattgggttggttg

SEQ ID NO: 6100 - DNA, 20 bp, Artificial
  20-mer unique DNA sequence
agacagttgaccgagggcgc

SEQ ID NO: 6101 - DNA, 20 bp, Artificial
  20-mer unique DNA sequence
gacgaggggacgaggggatt

SEQ ID NO: 6102 - DNA, 20 bp, Artificial
  20-mer unique DNA sequence
cgaccgtacgtgactttcgc

SEQ ID NO: 6103 - DNA, 20 bp, Artificial
  20-mer unique DNA sequence
ggccctgggattacgcaaaa

SEQ ID NO: 6104 - DNA, 20 bp, Artificial
  20-mer unique DNA sequence
taaggggagacttggtgcga

SEQ ID NO: 6105 - DNA, 20 bp, Artificial
  20-mer unique DNA sequence
gctggcgggaagaggaaggc

SEQ ID NO: 6106 - DNA, 20 bp, Artificial
  20-mer unique DNA sequence
cttcttgggttcgcctccgg

SEQ ID NO: 6107 - DNA, 20 bp, Artificial
  20-mer unique DNA sequence
agggtccggtatggcagggc

SEQ ID NO: 6108 - DNA, 20 bp, Artificial
  20-mer unique DNA sequence
ggggacggacgactggggag

SEQ ID NO: 6109 - DNA, 20 bp, Artificial
  20-mer unique DNA sequence
atcagcaatcggccaacccc

SEQ ID NO: 6110 - DNA, 20 bp, Artificial
  20-mer unique DNA sequence
acagaggctcctgagcgcaa

SEQ ID NO: 6111 - DNA, 20 bp, Artificial
  20-mer unique DNA sequence
aagcgccgcatgttagtgtg

SEQ ID NO: 6112 - DNA, 20 bp, Artificial
  20-mer unique DNA sequence
caaggcgtggcggagagttc

SEQ ID NO: 6113 - DNA, 20 bp, Artificial
  20-mer unique DNA sequence
aaaaagaggcaggcgggacg

SEQ ID NO: 6114 - DNA, 20 bp, Artificial
  20-mer unique DNA sequence
aatgcctgagctcaccgagg

SEQ ID NO: 6115 - DNA, 20 bp, Artificial
  20-mer unique DNA sequence
gtcactgggttgcggcgttg

SEQ ID NO: 6116 - DNA, 20 bp, Artificial
  20-mer unique DNA sequence
ggcaaggaggcggactgggt

SEQ ID NO: 6117 - DNA, 20 bp, Artificial
  20-mer unique DNA sequence
tgacagtttgacggcggggg

SEQ ID NO: 6118 - DNA, 20 bp, Artificial
  20-mer unique DNA sequence
tgaccgataagccccgggat

SEQ ID NO: 6119 - DNA, 20 bp, Artificial
  20-mer unique DNA sequence
agcggcgaggttgcatatgc

SEQ ID NO: 6120 - DNA, 20 bp, Artificial
  20-mer unique DNA sequence
tgccgtgttctccgcttcca

SEQ ID NO: 6121 - DNA, 20 bp, Artificial
  20-mer unique DNA sequence
tgaacgaccaagcacccccc

SEQ ID NO: 6122 - DNA, 20 bp, Artificial
  20-mer unique DNA sequence
gtgcgtcggacttcgatcct

SEQ ID NO: 6123 - DNA, 20 bp, Artificial
  20-mer unique DNA sequence
accctccgtgagctgggaat

SEQ ID NO: 6124 - DNA, 20 bp, Artificial
  20-mer unique DNA sequence
agaatagcaggccgcggaaa

SEQ ID NO: 6125 - DNA, 20 bp, Artificial
  20-mer unique DNA sequence
tttggcgacgttggacaggg

SEQ ID NO: 6126 - DNA, 20 bp, Artificial
  20-mer unique DNA sequence
tttggcgcgcattttcacat

SEQ ID NO: 6127 - DNA, 20 bp, Artificial
  20-mer unique DNA sequence
gcgcccagatctttccccac

SEQ ID NO: 6128 - DNA, 20 bp, Artificial
  20-mer unique DNA sequence
acctaacccgccgcaactgt

SEQ ID NO: 6129 - DNA, 20 bp, Artificial
  20-mer unique DNA sequence
cccccgctcttgtaccctcc

SEQ ID NO: 6130 - DNA, 20 bp, Artificial
  20-mer unique DNA sequence
cccctgtcccatccccgtcg

SEQ ID NO: 6131 - DNA, 20 bp, Artificial
  20-mer unique DNA sequence
cgggtgggcagcagattggt

SEQ ID NO: 6132 - DNA, 20 bp, Artificial
  20-mer unique DNA sequence
gtagggaatcagggcgggcg

SEQ ID NO: 6133 - DNA, 20 bp, Artificial
  20-mer unique DNA sequence
gtcctatcgaaaccccgcgg

SEQ ID NO: 6134 - DNA, 20 bp, Artificial
  20-mer unique DNA sequence
aggtccacattctcgcccgc

SEQ ID NO: 6135 - DNA, 20 bp, Artificial
  20-mer unique DNA sequence
actgcaacccccgctcatta

SEQ ID NO: 6136 - DNA, 20 bp, Artificial
  20-mer unique DNA sequence
attggttttgggcgctcgga

SEQ ID NO: 6137 - DNA, 20 bp, Artificial
  20-mer unique DNA sequence
aaaagcgacgtggggcaaac

SEQ ID NO: 6138 - DNA, 20 bp, Artificial
  20-mer unique DNA sequence
atccaccccgcataatccca

SEQ ID NO: 6139 - DNA, 20 bp, Artificial
  20-mer unique DNA sequence
tgggcttttgttcggatgca

SEQ ID NO: 6140 - DNA, 20 bp, Artificial
  20-mer unique DNA sequence
acgggcatggtcgacggcta

SEQ ID NO: 6141 - DNA, 20 bp, Artificial
  20-mer unique DNA sequence
tttccaagggcgggcgagtt

SEQ ID NO: 6142 - DNA, 20 bp, Artificial
  20-mer unique DNA sequence
gcccggcatactggtcgtct

SEQ ID NO: 6143 - DNA, 20 bp, Artificial
  20-mer unique DNA sequence
cacattcggtggttgagcgg

SEQ ID NO: 6144 - DNA, 20 bp, Artificial
  20-mer unique DNA sequence
tcgttggtttcagggcgcac

SEQ ID NO: 6145 - DNA, 20 bp, Artificial
  20-mer unique DNA sequence
ccttggaccgcaccctggac

SEQ ID NO: 6146 - DNA, 20 bp, Artificial
  20-mer unique DNA sequence
tggtctgttcgtgggcatgg

SEQ ID NO: 6147 - DNA, 20 bp, Artificial
  20-mer unique DNA sequence
tcagaagggggtgcacaggg

SEQ ID NO: 6148 - DNA, 20 bp, Artificial
  20-mer unique DNA sequence
cgcgaccccaccgagaccta

SEQ ID NO: 6149 - DNA, 20 bp, Artificial
  20-mer unique DNA sequence
ctgttcactgcgcgccctcc

SEQ ID NO: 6150 - DNA, 20 bp, Artificial
  20-mer unique DNA sequence
tacggcctgccacaggttag

SEQ ID NO: 6151 - DNA, 20 bp, Artificial
  20-mer unique DNA sequence
ggtgcaggcgtacgaactct

SEQ ID NO: 6152 - DNA, 20 bp, Artificial
  20-mer unique DNA sequence
caaggcgatcccacaaggct

SEQ ID NO: 6153 - DNA, 20 bp, Artificial
  20-mer unique DNA sequence
gcctacacgagaaccggcgt

SEQ ID NO: 6154 - DNA, 20 bp, Artificial
  20-mer unique DNA sequence
gacgaagaggcggggcaagt

SEQ ID NO: 6155 - DNA, 20 bp, Artificial
  20-mer unique DNA sequence
caaaaccccccaatccctgt

SEQ ID NO: 6156 - DNA, 20 bp, Artificial
  20-mer unique DNA sequence
ggacaatcggtgggagggtg

SEQ ID NO: 6157 - DNA, 20 bp, Artificial
  20-mer unique DNA sequence
agcgaccacgaagaacgcgg

SEQ ID NO: 6158 - DNA, 20 bp, Artificial
  20-mer unique DNA sequence
aaaacagttgcccgcgagcc

SEQ ID NO: 6159 - DNA, 20 bp, Artificial
  20-mer unique DNA sequence
gggagaaacgggcaggccta

SEQ ID NO: 6160 - DNA, 20 bp, Artificial
  20-mer unique DNA sequence
aacccggacgagcccaaagc

SEQ ID NO: 6161 - DNA, 20 bp, Artificial
  20-mer unique DNA sequence
ggagaggccatgcaacacgc

SEQ ID NO: 6162 - DNA, 20 bp, Artificial
  20-mer unique DNA sequence
ccaaaccccgaccgacaatc

SEQ ID NO: 6163 - DNA, 20 bp, Artificial
  20-mer unique DNA sequence
ccttttgccgtaccctcccg

SEQ ID NO: 6164 - DNA, 20 bp, Artificial
  20-mer unique DNA sequence
atcgtggaagctgcgcggtc

SEQ ID NO: 6165 - DNA, 20 bp, Artificial
  20-mer unique DNA sequence
tgtgacttggagggccggtg

SEQ ID NO: 6166 - DNA, 20 bp, Artificial
  20-mer unique DNA sequence
tggggtgtcgggcaggtagc

SEQ ID NO: 6167 - DNA, 20 bp, Artificial
  20-mer unique DNA sequence
aacagggaaggccgaccagg

SEQ ID NO: 6168 - DNA, 20 bp, Artificial
  20-mer unique DNA sequence
ggcttgtctcagggcgatct

SEQ ID NO: 6169 - DNA, 20 bp, Artificial
  20-mer unique DNA sequence
gcttactagggtgccagcgt

SEQ ID NO: 6170 - DNA, 20 bp, Artificial
  20-mer unique DNA sequence
ccgttcgtcccaccttgcca

SEQ ID NO: 6171 - DNA, 20 bp, Artificial
  20-mer unique DNA sequence
aacaaccgaaggggctgacg

SEQ ID NO: 6172 - DNA, 20 bp, Artificial
  20-mer unique DNA sequence
cggcagcggacaagagaggt

SEQ ID NO: 6173 - DNA, 20 bp, Artificial
  20-mer unique DNA sequence
ggctcactttcgcattcccc

SEQ ID NO: 6174 - DNA, 20 bp, Artificial
  20-mer unique DNA sequence
cgtagatccgccagaagccg

SEQ ID NO: 6175 - DNA, 20 bp, Artificial
  20-mer unique DNA sequence
gcccctccgtcacacacaca

SEQ ID NO: 6176 - DNA, 20 bp, Artificial
  20-mer unique DNA sequence
gttgtgggtggagggggcag

SEQ ID NO: 6177 - DNA, 20 bp, Artificial
  20-mer unique DNA sequence
gcccgtcactgccgaacctt

SEQ ID NO: 6178 - DNA, 20 bp, Artificial
  20-mer unique DNA sequence
gctcttgatgggcggggtgt

SEQ ID NO: 6179 - DNA, 20 bp, Artificial
  20-mer unique DNA sequence
catctggtcggcgttgtggc

SEQ ID NO: 6180 - DNA, 20 bp, Artificial
  20-mer unique DNA sequence
accccccgccaccatcgata

SEQ ID NO: 6181 - DNA, 20 bp, Artificial
  20-mer unique DNA sequence
tgcggagatagggtcggggc

SEQ ID NO: 6182 - DNA, 20 bp, Artificial
  20-mer unique DNA sequence
ggcgtcccgaaccatcagct

SEQ ID NO: 6183 - DNA, 20 bp, Artificial
  20-mer unique DNA sequence
cgtcctatcgggttcccttg

SEQ ID NO: 6184 - DNA, 20 bp, Artificial
  20-mer unique DNA sequence
ctggccatttcgcgacgttg

SEQ ID NO: 6185 - DNA, 20 bp, Artificial
  20-mer unique DNA sequence
cgcactcctcgaccaccctc

SEQ ID NO: 6186 - DNA, 20 bp, Artificial
  20-mer unique DNA sequence
cggatagtgggcgcttggtc

SEQ ID NO: 6187 - DNA, 20 bp, Artificial
  20-mer unique DNA sequence
ttaacccagcccgccccact

SEQ ID NO: 6188 - DNA, 20 bp, Artificial
  20-mer unique DNA sequence
ataccatccgccgccctgaa

SEQ ID NO: 6189 - DNA, 20 bp, Artificial
  20-mer unique DNA sequence
aaggggggggcaaggaccag

SEQ ID NO: 6190 - DNA, 20 bp, Artificial
  20-mer unique DNA sequence
agtcgcgtcacccatgtagg

SEQ ID NO: 6191 - DNA, 20 bp, Artificial
  20-mer unique DNA sequence
cctgcgtcacgaggctatga

SEQ ID NO: 6192 - DNA, 20 bp, Artificial
  20-mer unique DNA sequence
cgcctcgtcgccctttgtta

SEQ ID NO: 6193 - DNA, 20 bp, Artificial
  20-mer unique DNA sequence
atggccctcgatcacgtcag

SEQ ID NO: 6194 - DNA, 20 bp, Artificial
  20-mer unique DNA sequence
tcgcggattgataacgtggc

SEQ ID NO: 6195 - DNA, 20 bp, Artificial
  20-mer unique DNA sequence
gatagccacccattgcgccc

SEQ ID NO: 6196 - DNA, 20 bp, Artificial
  20-mer unique DNA sequence
tttgcgcaccggtatgcacc

SEQ ID NO: 6197 - DNA, 20 bp, Artificial
  20-mer unique DNA sequence
ctaggagggagcgaagggca

SEQ ID NO: 6198 - DNA, 20 bp, Artificial
  20-mer unique DNA sequence
aagatcaaaccgccacccga

SEQ ID NO: 6199 - DNA, 20 bp, Artificial
  20-mer unique DNA sequence
tagacccctcgccgtttgcg

SEQ ID NO: 6200 - DNA, 20 bp, Artificial
  20-mer unique DNA sequence
cacggttcagcatgggtcgg

SEQ ID NO: 6201 - DNA, 20 bp, Artificial
  20-mer unique DNA sequence
cgccccctttgtcgatggtt

SEQ ID NO: 6202 - DNA, 20 bp, Artificial
  20-mer unique DNA sequence
tttggcttgggaatgggcga

SEQ ID NO: 6203 - DNA, 20 bp, Artificial
  20-mer unique DNA sequence
cgtggcggagcggagaagat

SEQ ID NO: 6204 - DNA, 20 bp, Artificial
  20-mer unique DNA sequence
agaccggagcgaggcgatta

SEQ ID NO: 6205 - DNA, 20 bp, Artificial
  20-mer unique DNA sequence
acccagtgcacctgtgaagg

SEQ ID NO: 6206 - DNA, 20 bp, Artificial
  20-mer unique DNA sequence
gacccctcccggcattcgtt

SEQ ID NO: 6207 - DNA, 20 bp, Artificial
  20-mer unique DNA sequence
agtggggcagacgcgtgaag

SEQ ID NO: 6208 - DNA, 20 bp, Artificial
  20-mer unique DNA sequence
tttcagttgggctggacggc

SEQ ID NO: 6209 - DNA, 20 bp, Artificial
  20-mer unique DNA sequence
catctgtcccgctccgcacc

SEQ ID NO: 6210 - DNA, 20 bp, Artificial
  20-mer unique DNA sequence
ggatcgagtttggcgggttg

SEQ ID NO: 6211 - DNA, 20 bp, Artificial
  20-mer unique DNA sequence
accgctagcaccgaacgcca

SEQ ID NO: 6212 - DNA, 20 bp, Artificial
  20-mer unique DNA sequence
accgcggaaacgcgtagagt

SEQ ID NO: 6213 - DNA, 20 bp, Artificial
  20-mer unique DNA sequence
gcccgatctcgcatagcctt

SEQ ID NO: 6214 - DNA, 20 bp, Artificial
  20-mer unique DNA sequence
ggtgccccctttaaatcgcc

SEQ ID NO: 6215 - DNA, 20 bp, Artificial
  20-mer unique DNA sequence
aaggcctgcgtagcgactga

SEQ ID NO: 6216 - DNA, 20 bp, Artificial
  20-mer unique DNA sequence
cgggatcaagagagggggct

SEQ ID NO: 6217 - DNA, 20 bp, Artificial
  20-mer unique DNA sequence
ttgccccgccacttgatctt

SEQ ID NO: 6218 - DNA, 20 bp, Artificial
  20-mer unique DNA sequence
gcacgaaagatggcgggcag

SEQ ID NO: 6219 - DNA, 20 bp, Artificial
  20-mer unique DNA sequence
gggcggtccagtttggggat

SEQ ID NO: 6220 - DNA, 20 bp, Artificial
  20-mer unique DNA sequence
atcgttgacagaggccggga

SEQ ID NO: 6221 - DNA, 20 bp, Artificial
  20-mer unique DNA sequence
ggcggccgaacgaaaagtac

SEQ ID NO: 6222 - DNA, 20 bp, Artificial
  20-mer unique DNA sequence
attcacttccgtgggcggcc

SEQ ID NO: 6223 - DNA, 20 bp, Artificial
  20-mer unique DNA sequence
gtggtgacagacggccaggc

SEQ ID NO: 6224 - DNA, 20 bp, Artificial
  20-mer unique DNA sequence
actcttagggcgcccgttac

SEQ ID NO: 6225 - DNA, 20 bp, Artificial
  20-mer unique DNA sequence
gagtgcgattcggggacgta

SEQ ID NO: 6226 - DNA, 20 bp, Artificial
  20-mer unique DNA sequence
atcgcggaggggctaacaca

SEQ ID NO: 6227 - DNA, 20 bp, Artificial
  20-mer unique DNA sequence
tgcttgtccggctcttcgct

SEQ ID NO: 6228 - DNA, 20 bp, Artificial
  20-mer unique DNA sequence
acaccgccccactccaaaaa

SEQ ID NO: 6229 - DNA, 20 bp, Artificial
  20-mer unique DNA sequence
attgcggggggtccagttga

SEQ ID NO: 6230 - DNA, 20 bp, Artificial
  20-mer unique DNA sequence
ttaccccttcgcccgcagtt

SEQ ID NO: 6231 - DNA, 20 bp, Artificial
  20-mer unique DNA sequence
cgatgatttgggggtcgtgg

SEQ ID NO: 6232 - DNA, 20 bp, Artificial
  20-mer unique DNA sequence
cgtccgcagaacatggctcc

SEQ ID NO: 6233 - DNA, 20 bp, Artificial
  20-mer unique DNA sequence
tcccgagggctagcacagga

SEQ ID NO: 6234 - DNA, 20 bp, Artificial
  20-mer unique DNA sequence
cggccatagtcgtcggttct

SEQ ID NO: 6235 - DNA, 20 bp, Artificial
  20-mer unique DNA sequence
acacctgatcacccccgctc

SEQ ID NO: 6236 - DNA, 20 bp, Artificial
  20-mer unique DNA sequence
tgattgccttgggggtgtga

SEQ ID NO: 6237 - DNA, 20 bp, Artificial
  20-mer unique DNA sequence
ccttcatccctgctgcccga

SEQ ID NO: 6238 - DNA, 20 bp, Artificial
  20-mer unique DNA sequence
tagggaccgactgccggaac

SEQ ID NO: 6239 - DNA, 20 bp, Artificial
  20-mer unique DNA sequence
aatgacccacgggagacggt

SEQ ID NO: 6240 - DNA, 20 bp, Artificial
  20-mer unique DNA sequence
ctcgcccgtcttctctcgct

SEQ ID NO: 6241 - DNA, 20 bp, Artificial
  20-mer unique DNA sequence
gttcggcgtccattgcaggt

SEQ ID NO: 6242 - DNA, 20 bp, Artificial
  20-mer unique DNA sequence
tgctccaatcccgaccccag

SEQ ID NO: 6243 - DNA, 20 bp, Artificial
  20-mer unique DNA sequence
ctcctccgccctcggctaac

SEQ ID NO: 6244 - DNA, 20 bp, Artificial
  20-mer unique DNA sequence
tgtgaacgccgtctggcaac

SEQ ID NO: 6245 - DNA, 20 bp, Artificial
  20-mer unique DNA sequence
ttaggcattctgggaccggg

SEQ ID NO: 6246 - DNA, 20 bp, Artificial
  20-mer unique DNA sequence
atgtagggcgactctcccgt

SEQ ID NO: 6247 - DNA, 20 bp, Artificial
  20-mer unique DNA sequence
aacgcggctctgttctaccg

SEQ ID NO: 6248 - DNA, 20 bp, Artificial
  20-mer unique DNA sequence
tgctttctgcgtccggctgt

SEQ ID NO: 6249 - DNA, 20 bp, Artificial
  20-mer unique DNA sequence
cggagtggacacgacactga

SEQ ID NO: 6250 - DNA, 20 bp, Artificial
  20-mer unique DNA sequence
gcgaatgggagcgaaaatcg

SEQ ID NO: 6251 - DNA, 20 bp, Artificial
  20-mer unique DNA sequence
ggggcgatgtgagaggcaaa

SEQ ID NO: 6252 - DNA, 20 bp, Artificial
  20-mer unique DNA sequence
tgtaacgacgggggcgaagc

SEQ ID NO: 6253 - DNA, 20 bp, Artificial
  20-mer unique DNA sequence
gacccatcgaacccgccaca

SEQ ID NO: 6254 - DNA, 20 bp, Artificial
  20-mer unique DNA sequence
attgtcccgtgcttgccccc

SEQ ID NO: 6255 - DNA, 20 bp, Artificial
  20-mer unique DNA sequence
ggcggttgtggctgatcgac

SEQ ID NO: 6256 - DNA, 20 bp, Artificial
  20-mer unique DNA sequence
ataacccactgcccggacca

SEQ ID NO: 6257 - DNA, 20 bp, Artificial
  20-mer unique DNA sequence
catctcctcggcgactcacg

SEQ ID NO: 6258 - DNA, 20 bp, Artificial
  20-mer unique DNA sequence
attgcgggaaagtgcgacct

SEQ ID NO: 6259 - DNA, 20 bp, Artificial
  20-mer unique DNA sequence
aggtaagcatgaacgtgcgc

SEQ ID NO: 6260 - DNA, 20 bp, Artificial
  20-mer unique DNA sequence
caaaaattccgcaaacggcg

SEQ ID NO: 6261 - DNA, 20 bp, Artificial
  20-mer unique DNA sequence
agccttgctgtccgccctag

SEQ ID NO: 6262 - DNA, 20 bp, Artificial
  20-mer unique DNA sequence
cggcgagaggcaaaaggcaa

SEQ ID NO: 6263 - DNA, 20 bp, Artificial
  20-mer unique DNA sequence
ttacccgccagcatcccagg

SEQ ID NO: 6264 - DNA, 20 bp, Artificial
  20-mer unique DNA sequence
ctcgcgtagccgctgatcta

SEQ ID NO: 6265 - DNA, 20 bp, Artificial
  20-mer unique DNA sequence
tcgctgcgcaggtctttagg

SEQ ID NO: 6266 - DNA, 20 bp, Artificial
  20-mer unique DNA sequence
acccctcgtgctggtttgtc

SEQ ID NO: 6267 - DNA, 20 bp, Artificial
  20-mer unique DNA sequence
ctgcccttccctaaccgcct

SEQ ID NO: 6268 - DNA, 20 bp, Artificial
  20-mer unique DNA sequence
ccagaaagcggtaggggtcg

SEQ ID NO: 6269 - DNA, 20 bp, Artificial
  20-mer unique DNA sequence
tgacaatccctgcgccatcg

SEQ ID NO: 6270 - DNA, 20 bp, Artificial
  20-mer unique DNA sequence
ggggatgggttgtgggacag

SEQ ID NO: 6271 - DNA, 20 bp, Artificial
  20-mer unique DNA sequence
aaggtatgcgcgtgcgggtg

SEQ ID NO: 6272 - DNA, 20 bp, Artificial
  20-mer unique DNA sequence
aggaccccgagcacaacccg

SEQ ID NO: 6273 - DNA, 20 bp, Artificial
  20-mer unique DNA sequence
gcgggaaccgaaagggaagg

SEQ ID NO: 6274 - DNA, 20 bp, Artificial
  20-mer unique DNA sequence
cactaaaagcctgcaccgcg

SEQ ID NO: 6275 - DNA, 20 bp, Artificial
  20-mer unique DNA sequence
acaaggccggggtcagtccc

SEQ ID NO: 6276 - DNA, 20 bp, Artificial
  20-mer unique DNA sequence
ttccgaccgccactacaccc

SEQ ID NO: 6277 - DNA, 20 bp, Artificial
  20-mer unique DNA sequence
aggggttgtcgttatggcgg

SEQ ID NO: 6278 - DNA, 20 bp, Artificial
  20-mer unique DNA sequence
gcagtgggggaggaccgaac

SEQ ID NO: 6279 - DNA, 20 bp, Artificial
  20-mer unique DNA sequence
tccgacccgaccacgctttg

SEQ ID NO: 6280 - DNA, 20 bp, Artificial
  20-mer unique DNA sequence
cagacgaattcccatgcggg

SEQ ID NO: 6281 - DNA, 20 bp, Artificial
  20-mer unique DNA sequence
agttagcggttccatcgccg

SEQ ID NO: 6282 - DNA, 20 bp, Artificial
  20-mer unique DNA sequence
gcggaggggtgtcggatagc

SEQ ID NO: 6283 - DNA, 20 bp, Artificial
  20-mer unique DNA sequence
atgcttctcggggggttgct

SEQ ID NO: 6284 - DNA, 20 bp, Artificial
  20-mer unique DNA sequence
atactcagccctggaccgga

SEQ ID NO: 6285 - DNA, 20 bp, Artificial
  20-mer unique DNA sequence
atccggtcagtctgtgccag

SEQ ID NO: 6286 - DNA, 20 bp, Artificial
  20-mer unique DNA sequence
gtttcctggggtgaggtcgc

SEQ ID NO: 6287 - DNA, 20 bp, Artificial
  20-mer unique DNA sequence
acccccctcccccaacatag

SEQ ID NO: 6288 - DNA, 20 bp, Artificial
  20-mer unique DNA sequence
gccttttcctcgccgctctc

SEQ ID NO: 6289 - DNA, 20 bp, Artificial
  20-mer unique DNA sequence
accgcggccgtcctactttg

SEQ ID NO: 6290 - DNA, 20 bp, Artificial
  20-mer unique DNA sequence
aacgtcgccgaaacagcacc

SEQ ID NO: 6291 - DNA, 20 bp, Artificial
  20-mer unique DNA sequence
cacacgggtgcattcgcaat

SEQ ID NO: 6292 - DNA, 20 bp, Artificial
  20-mer unique DNA sequence
caaagcctctccacccccct

SEQ ID NO: 6293 - DNA, 20 bp, Artificial
  20-mer unique DNA sequence
gcgcgcacgtgaggtacaag

SEQ ID NO: 6294 - DNA, 20 bp, Artificial
  20-mer unique DNA sequence
gaggatatttggccgctggg

SEQ ID NO: 6295 - DNA, 20 bp, Artificial
  20-mer unique DNA sequence
gcccaggtaccaatgcacag

SEQ ID NO: 6296 - DNA, 20 bp, Artificial
  20-mer unique DNA sequence
gccccgggttatggaagctt

SEQ ID NO: 6297 - DNA, 20 bp, Artificial
  20-mer unique DNA sequence
gctgccggctgggtaacaac

SEQ ID NO: 6298 - DNA, 20 bp, Artificial
  20-mer unique DNA sequence
ctgacacatccgccgcaacg

SEQ ID NO: 6299 - DNA, 20 bp, Artificial
  20-mer unique DNA sequence
ccttggcttggcccgtctct

SEQ ID NO: 6300 - DNA, 20 bp, Artificial
  20-mer unique DNA sequence
gccccagcgcccactatgtt

SEQ ID NO: 6301 - DNA, 20 bp, Artificial
  20-mer unique DNA sequence
tctcgacaccaccaaagcgc

SEQ ID NO: 6302 - DNA, 20 bp, Artificial
  20-mer unique DNA sequence
tcgttgacatgactccccgg

SEQ ID NO: 6303 - DNA, 20 bp, Artificial
  20-mer unique DNA sequence
gaagggtaggccgggtgtcc

SEQ ID NO: 6304 - DNA, 20 bp, Artificial
  20-mer unique DNA sequence
atacgcggccgagttgtact

SEQ ID NO: 6305 - DNA, 20 bp, Artificial
  20-mer unique DNA sequence
gctcagtgcaccggctagtt

SEQ ID NO: 6306 - DNA, 20 bp, Artificial
  20-mer unique DNA sequence
taaatacccgggtgccgctg

SEQ ID NO: 6307 - DNA, 20 bp, Artificial
  20-mer unique DNA sequence
tcgagtgcacccgtagacac

SEQ ID NO: 6308 - DNA, 20 bp, Artificial
  20-mer unique DNA sequence
aggcaagcggcatagggcag

SEQ ID NO: 6309 - DNA, 20 bp, Artificial
  20-mer unique DNA sequence
tgttggagctctttggcggc

SEQ ID NO: 6310 - DNA, 20 bp, Artificial
  20-mer unique DNA sequence
ctagggatgggagcgggcag

SEQ ID NO: 6311 - DNA, 20 bp, Artificial
  20-mer unique DNA sequence
aggttgcggggaagtgttgg

SEQ ID NO: 6312 - DNA, 20 bp, Artificial
  20-mer unique DNA sequence
gccaccctgctttgaccgct

SEQ ID NO: 6313 - DNA, 20 bp, Artificial
  20-mer unique DNA sequence
aaaaatgcgaggacgggggg

SEQ ID NO: 6314 - DNA, 20 bp, Artificial
  20-mer unique DNA sequence
cgctttcccgtcaggtccaa

SEQ ID NO: 6315 - DNA, 20 bp, Artificial
  20-mer unique DNA sequence
ccaagagcaagcgcataacg

SEQ ID NO: 6316 - DNA, 20 bp, Artificial
  20-mer unique DNA sequence
aacgtctcgaatcgggcacc

SEQ ID NO: 6317 - DNA, 20 bp, Artificial
  20-mer unique DNA sequence
ataaactcgcacggacgccg

SEQ ID NO: 6318 - DNA, 20 bp, Artificial
  20-mer unique DNA sequence
caccattcacgttccgccct

SEQ ID NO: 6319 - DNA, 20 bp, Artificial
  20-mer unique DNA sequence
aacggggacacggaaccatc

SEQ ID NO: 6320 - DNA, 20 bp, Artificial
  20-mer unique DNA sequence
cacctagccgcgctaaggtt

SEQ ID NO: 6321 - DNA, 20 bp, Artificial
  20-mer unique DNA sequence
aatcttttgtcgtggggccg

SEQ ID NO: 6322 - DNA, 20 bp, Artificial
  20-mer unique DNA sequence
ggaccgagggcgtgtgaaag

SEQ ID NO: 6323 - DNA, 20 bp, Artificial
  20-mer unique DNA sequence
gctggcttaggggcgtgagt

SEQ ID NO: 6324 - DNA, 20 bp, Artificial
  20-mer unique DNA sequence
actacccgatccgaccaccc

SEQ ID NO: 6325 - DNA, 20 bp, Artificial
  20-mer unique DNA sequence
aacgtacacccgccagcctc

SEQ ID NO: 6326 - DNA, 20 bp, Artificial
  20-mer unique DNA sequence
ttgtggccgtcctttcgttg

SEQ ID NO: 6327 - DNA, 20 bp, Artificial
  20-mer unique DNA sequence
ggacgcgggtgggcttaatt

SEQ ID NO: 6328 - DNA, 20 bp, Artificial
  20-mer unique DNA sequence
cgaccctgcaaagccaaaca

SEQ ID NO: 6329 - DNA, 20 bp, Artificial
  20-mer unique DNA sequence
gaggggctagtgcgggtctg

SEQ ID NO: 6330 - DNA, 20 bp, Artificial
  20-mer unique DNA sequence
ggggcgcgatttttgtgact

SEQ ID NO: 6331 - DNA, 20 bp, Artificial
  20-mer unique DNA sequence
atagggctggcgaggcggag

SEQ ID NO: 6332 - DNA, 20 bp, Artificial
  20-mer unique DNA sequence
cccgccacggatccattcag

SEQ ID NO: 6333 - DNA, 20 bp, Artificial
  20-mer unique DNA sequence
ccaccgatgacctgccttcc

SEQ ID NO: 6334 - DNA, 20 bp, Artificial
  20-mer unique DNA sequence
gaggtcgcggggagttcaag

SEQ ID NO: 6335 - DNA, 20 bp, Artificial
  20-mer unique DNA sequence
gggggcgagggacgagctat

SEQ ID NO: 6336 - DNA, 20 bp, Artificial
  20-mer unique DNA sequence
cttgcggatccatttgcccg

SEQ ID NO: 6337 - DNA, 20 bp, Artificial
  20-mer unique DNA sequence
ccagatctcgagcagccacg

SEQ ID NO: 6338 - DNA, 20 bp, Artificial
  20-mer unique DNA sequence
gcgggaaagaggggcaggat

SEQ ID NO: 6339 - DNA, 20 bp, Artificial
  20-mer unique DNA sequence
cggcttcccaccgacctcct

SEQ ID NO: 6340 - DNA, 20 bp, Artificial
  20-mer unique DNA sequence
tgcccctgctgattttgttc

SEQ ID NO: 6341 - DNA, 20 bp, Artificial
  20-mer unique DNA sequence
caagcgggggtactggggca

SEQ ID NO: 6342 - DNA, 20 bp, Artificial
  20-mer unique DNA sequence
gccagccgatatgttcccgt

SEQ ID NO: 6343 - DNA, 20 bp, Artificial
  20-mer unique DNA sequence
ttggggcacggcgggtaaat

SEQ ID NO: 6344 - DNA, 20 bp, Artificial
  20-mer unique DNA sequence
tttgggggctgtgaggcgaa

SEQ ID NO: 6345 - DNA, 20 bp, Artificial
  20-mer unique DNA sequence
cgagccgcctatcaccacaa

SEQ ID NO: 6346 - DNA, 20 bp, Artificial
  20-mer unique DNA sequence
aagggggcttcgcgtgtctt

SEQ ID NO: 6347 - DNA, 20 bp, Artificial
  20-mer unique DNA sequence
gttggggcacttgagcgagc

SEQ ID NO: 6348 - DNA, 20 bp, Artificial
  20-mer unique DNA sequence
gcccctgggacattgttgga

SEQ ID NO: 6349 - DNA, 20 bp, Artificial
  20-mer unique DNA sequence
tgcctccgctagcgctcaac

SEQ ID NO: 6350 - DNA, 20 bp, Artificial
  20-mer unique DNA sequence
aaaaagtgaagcgctcgggg

SEQ ID NO: 6351 - DNA, 20 bp, Artificial
  20-mer unique DNA sequence
gctctggttgcggtgccata

SEQ ID NO: 6352 - DNA, 20 bp, Artificial
  20-mer unique DNA sequence
agtctcgtgcgcggtttccc

SEQ ID NO: 6353 - DNA, 20 bp, Artificial
  20-mer unique DNA sequence
gtagcggccgcaggggaaaa

SEQ ID NO: 6354 - DNA, 20 bp, Artificial
  20-mer unique DNA sequence
cgcccaaccgccaaatgaag

SEQ ID NO: 6355 - DNA, 20 bp, Artificial
  20-mer unique DNA sequence
ccaacgcacaaacaaaccgc

SEQ ID NO: 6356 - DNA, 20 bp, Artificial
  20-mer unique DNA sequence
gagtcagggatggcggtgga

SEQ ID NO: 6357 - DNA, 20 bp, Artificial
  20-mer unique DNA sequence
acccgaccctacgctaccgc

SEQ ID NO: 6358 - DNA, 20 bp, Artificial
  20-mer unique DNA sequence
gggccccgcaagttacgaat

SEQ ID NO: 6359 - DNA, 20 bp, Artificial
  20-mer unique DNA sequence
gtcactacgaaggccggccc

SEQ ID NO: 6360 - DNA, 20 bp, Artificial
  20-mer unique DNA sequence
tccagccccgtcattatccg

SEQ ID NO: 6361 - DNA, 20 bp, Artificial
  20-mer unique DNA sequence
caatgtaatgaccgcggccg

SEQ ID NO: 6362 - DNA, 20 bp, Artificial
  20-mer unique DNA sequence
cgtcagctcctatgcggtct

SEQ ID NO: 6363 - DNA, 20 bp, Artificial
  20-mer unique DNA sequence
ctgccccctatgacccgcac

SEQ ID NO: 6364 - DNA, 20 bp, Artificial
  20-mer unique DNA sequence
ggatctacgtgggtcgggcc

SEQ ID NO: 6365 - DNA, 20 bp, Artificial
  20-mer unique DNA sequence
cacggcgggaggaataggaa

SEQ ID NO: 6366 - DNA, 20 bp, Artificial
  20-mer unique DNA sequence
atccacccccaaaccctgcc

SEQ ID NO: 6367 - DNA, 20 bp, Artificial
  20-mer unique DNA sequence
ttcggttcggttcaatgggc

SEQ ID NO: 6368 - DNA, 20 bp, Artificial
  20-mer unique DNA sequence
cgggttgggaaagttgagcg

SEQ ID NO: 6369 - DNA, 20 bp, Artificial
  20-mer unique DNA sequence
tcttcagtcccccaggccgt

SEQ ID NO: 6370 - DNA, 20 bp, Artificial
  20-mer unique DNA sequence
tgcttccccccgtcgctaac

SEQ ID NO: 6371 - DNA, 20 bp, Artificial
  20-mer unique DNA sequence
cggtcgttttcgtgcccatt

SEQ ID NO: 6372 - DNA, 20 bp, Artificial
  20-mer unique DNA sequence
caagcagattacagcgcggc

SEQ ID NO: 6373 - DNA, 20 bp, Artificial
  20-mer unique DNA sequence
gcgaaaaacgaccgggggag

SEQ ID NO: 6374 - DNA, 20 bp, Artificial
  20-mer unique DNA sequence
aaatggtgcgatggcgtgct

SEQ ID NO: 6375 - DNA, 20 bp, Artificial
  20-mer unique DNA sequence
tttatcgcctgcccaatccc

SEQ ID NO: 6376 - DNA, 20 bp, Artificial
  20-mer unique DNA sequence
acatccgtgggccctttggc

SEQ ID NO: 6377 - DNA, 20 bp, Artificial
  20-mer unique DNA sequence
tttcggcgctccatgagtca

SEQ ID NO: 6378 - DNA, 20 bp, Artificial
  20-mer unique DNA sequence
caaaagtgtgcccggctgca

SEQ ID NO: 6379 - DNA, 20 bp, Artificial
  20-mer unique DNA sequence
cgagccgttgagatgtccca

SEQ ID NO: 6380 - DNA, 20 bp, Artificial
  20-mer unique DNA sequence
tccaaacgggccatcacgat

SEQ ID NO: 6381 - DNA, 20 bp, Artificial
  20-mer unique DNA sequence
aagtggtgcgtgcgcgtctc

SEQ ID NO: 6382 - DNA, 20 bp, Artificial
  20-mer unique DNA sequence
tccaatacctgctcgggcct

SEQ ID NO: 6383 - DNA, 20 bp, Artificial
  20-mer unique DNA sequence
catcaattcccgcgccagac

SEQ ID NO: 6384 - DNA, 20 bp, Artificial
  20-mer unique DNA sequence
tgccaggtgatgtccgatcc

SEQ ID NO: 6385 - DNA, 20 bp, Artificial
  20-mer unique DNA sequence
gtcgggcttgctgcttttgg

SEQ ID NO: 6386 - DNA, 20 bp, Artificial
  20-mer unique DNA sequence
ccgggagctgtatggatggc

SEQ ID NO: 6387 - DNA, 20 bp, Artificial
  20-mer unique DNA sequence
gcgccgtcttaagcccatgt

SEQ ID NO: 6388 - DNA, 20 bp, Artificial
  20-mer unique DNA sequence
tcctcgactcacattgcgcc

SEQ ID NO: 6389 - DNA, 20 bp, Artificial
  20-mer unique DNA sequence
gccctgcgtcccctaacacc

SEQ ID NO: 6390 - DNA, 20 bp, Artificial
  20-mer unique DNA sequence
tgctgtgtagtgggcgacgg

SEQ ID NO: 6391 - DNA, 20 bp, Artificial
  20-mer unique DNA sequence
tcgaccctgcccaaccaaga

SEQ ID NO: 6392 - DNA, 20 bp, Artificial
  20-mer unique DNA sequence
cgaagtgcgggacagcaggc

SEQ ID NO: 6393 - DNA, 20 bp, Artificial
  20-mer unique DNA sequence
tttccggctgcaaacgctct

SEQ ID NO: 6394 - DNA, 20 bp, Artificial
  20-mer unique DNA sequence
ctccacacgaaacgcgcgac

SEQ ID NO: 6395 - DNA, 20 bp, Artificial
  20-mer unique DNA sequence
tactctcgccgcgctcatcc

SEQ ID NO: 6396 - DNA, 20 bp, Artificial
  20-mer unique DNA sequence
gggtctggttccggggtcga

SEQ ID NO: 6397 - DNA, 20 bp, Artificial
  20-mer unique DNA sequence
ccccgctggcccaattcttc

SEQ ID NO: 6398 - DNA, 20 bp, Artificial
  20-mer unique DNA sequence
ttcccgtgctcggaccatag

SEQ ID NO: 6399 - DNA, 20 bp, Artificial
  20-mer unique DNA sequence
aacgtaggagatgggccggc

SEQ ID NO: 6400 - DNA, 20 bp, Artificial
  20-mer unique DNA sequence
aaccgttcgctcccatcctg

SEQ ID NO: 6401 - DNA, 20 bp, Artificial
  20-mer unique DNA sequence
cccctcggcgatagctccac

SEQ ID NO: 6402 - DNA, 20 bp, Artificial
  20-mer unique DNA sequence
ccgagtcacgcccacgagtc

SEQ ID NO: 6403 - DNA, 20 bp, Artificial
  20-mer unique DNA sequence
tcgattaggtcggccggtcg

SEQ ID NO: 6404 - DNA, 20 bp, Artificial
  20-mer unique DNA sequence
taacaccctctcgcgcctgg

SEQ ID NO: 6405 - DNA, 20 bp, Artificial
  20-mer unique DNA sequence
tgaggataaccggtgggcgt

SEQ ID NO: 6406 - DNA, 20 bp, Artificial
  20-mer unique DNA sequence
caagaggtgtgtgcgggggc

SEQ ID NO: 6407 - DNA, 20 bp, Artificial
  20-mer unique DNA sequence
cgggcaggaagggaaggtcg

SEQ ID NO: 6408 - DNA, 20 bp, Artificial
  20-mer unique DNA sequence
tccagggcccgcttaccagc

SEQ ID NO: 6409 - DNA, 20 bp, Artificial
  20-mer unique DNA sequence
tagcgcagccccctcaaaaa

SEQ ID NO: 6410 - DNA, 20 bp, Artificial
  20-mer unique DNA sequence
agcggacgctagtgctggat

SEQ ID NO: 6411 - DNA, 20 bp, Artificial
  20-mer unique DNA sequence
tacgccgtgcgctatgaaca

SEQ ID NO: 6412 - DNA, 20 bp, Artificial
  20-mer unique DNA sequence
agcaggcgcgacaggttggt

SEQ ID NO: 6413 - DNA, 20 bp, Artificial
  20-mer unique DNA sequence
gtaaggcgggcagcaaggtg

SEQ ID NO: 6414 - DNA, 20 bp, Artificial
  20-mer unique DNA sequence
gcagcgtgccgcctatctct

SEQ ID NO: 6415 - DNA, 20 bp, Artificial
  20-mer unique DNA sequence
ctttcccctatcgggcgtgc

SEQ ID NO: 6416 - DNA, 20 bp, Artificial
  20-mer unique DNA sequence
actaaacccgccgcactcga

SEQ ID NO: 6417 - DNA, 20 bp, Artificial
  20-mer unique DNA sequence
gactttcggctcggcgggtt

SEQ ID NO: 6418 - DNA, 20 bp, Artificial
  20-mer unique DNA sequence
ggcagatgtggcggtgacgt

SEQ ID NO: 6419 - DNA, 20 bp, Artificial
  20-mer unique DNA sequence
acaaatccgttgccgtgcgt

SEQ ID NO: 6420 - DNA, 20 bp, Artificial
  20-mer unique DNA sequence
tttcccggtgcgcgttttga

SEQ ID NO: 6421 - DNA, 20 bp, Artificial
  20-mer unique DNA sequence
ttggtgggctttgggcatcg

SEQ ID NO: 6422 - DNA, 20 bp, Artificial
  20-mer unique DNA sequence
gtcgggcgtgcctgggtaat

SEQ ID NO: 6423 - DNA, 20 bp, Artificial
  20-mer unique DNA sequence
ccctttcttgccatgccccc

SEQ ID NO: 6424 - DNA, 20 bp, Artificial
  20-mer unique DNA sequence
acatcaaggccccaacaggg

SEQ ID NO: 6425 - DNA, 20 bp, Artificial
  20-mer unique DNA sequence
tcaccttgacctcgctcccc

SEQ ID NO: 6426 - DNA, 20 bp, Artificial
  20-mer unique DNA sequence
aggtctcgaaagccgcgcgt

SEQ ID NO: 6427 - DNA, 20 bp, Artificial
  20-mer unique DNA sequence
acgttttgggttggttggcc

SEQ ID NO: 6428 - DNA, 20 bp, Artificial
  20-mer unique DNA sequence
tacgaattgaggcgccggaa

SEQ ID NO: 6429 - DNA, 20 bp, Artificial
  20-mer unique DNA sequence
tgggcacgcgagggtaactg

SEQ ID NO: 6430 - DNA, 20 bp, Artificial
  20-mer unique DNA sequence
acggccaattttccctgcac

SEQ ID NO: 6431 - DNA, 20 bp, Artificial
  20-mer unique DNA sequence
aaacgcgccagccactcttg

SEQ ID NO: 6432 - DNA, 20 bp, Artificial
  20-mer unique DNA sequence
ccataacttggcccatgccg

SEQ ID NO: 6433 - DNA, 20 bp, Artificial
  20-mer unique DNA sequence
gggctccggctcacacttat

SEQ ID NO: 6434 - DNA, 20 bp, Artificial
  20-mer unique DNA sequence
gagtcttgcgtgggtggctg

SEQ ID NO: 6435 - DNA, 20 bp, Artificial
  20-mer unique DNA sequence
cgcccaactcccgcactcta

SEQ ID NO: 6436 - DNA, 20 bp, Artificial
  20-mer unique DNA sequence
cgtgggcgtaacaatccgga

SEQ ID NO: 6437 - DNA, 20 bp, Artificial
  20-mer unique DNA sequence
tgaaacttaccccggcgacg

SEQ ID NO: 6438 - DNA, 20 bp, Artificial
  20-mer unique DNA sequence
tcacatcgctgtagaggcca

SEQ ID NO: 6439 - DNA, 20 bp, Artificial
  20-mer unique DNA sequence
gccaatctagcgcggaccca

SEQ ID NO: 6440 - DNA, 20 bp, Artificial
  20-mer unique DNA sequence
tcggggcattctggtgggtg

SEQ ID NO: 6441 - DNA, 20 bp, Artificial
  20-mer unique DNA sequence
ccaaaaagccccttcccacc

SEQ ID NO: 6442 - DNA, 20 bp, Artificial
  20-mer unique DNA sequence
taccccgtggtttctgcgga

SEQ ID NO: 6443 - DNA, 20 bp, Artificial
  20-mer unique DNA sequence
aggcgcgcgaacatacgtca

SEQ ID NO: 6444 - DNA, 20 bp, Artificial
  20-mer unique DNA sequence
atgtaacccgcgtaccgtgc

SEQ ID NO: 6445 - DNA, 20 bp, Artificial
  20-mer unique DNA sequence
actacacggggcgcgtaaat

SEQ ID NO: 6446 - DNA, 20 bp, Artificial
  20-mer unique DNA sequence
gacaacacccacacgcggga

SEQ ID NO: 6447 - DNA, 20 bp, Artificial
  20-mer unique DNA sequence
tacgtgtgccgcgtggcttt

SEQ ID NO: 6448 - DNA, 20 bp, Artificial
  20-mer unique DNA sequence
tccatctcgctcaccatccg

SEQ ID NO: 6449 - DNA, 20 bp, Artificial
  20-mer unique DNA sequence
gcgggaagcgaactgcgaag

SEQ ID NO: 6450 - DNA, 20 bp, Artificial
  20-mer unique DNA sequence
cgctggcgatccgatatgaa

SEQ ID NO: 6451 - DNA, 20 bp, Artificial
  20-mer unique DNA sequence
aattggagtttggtgcgcgc

SEQ ID NO: 6452 - DNA, 20 bp, Artificial
  20-mer unique DNA sequence
cggtctcccccccagaaagg

SEQ ID NO: 6453 - DNA, 20 bp, Artificial
  20-mer unique DNA sequence
cccgccatcacccagaatcc

SEQ ID NO: 6454 - DNA, 20 bp, Artificial
  20-mer unique DNA sequence
aagcccatccgcaaccatcc

SEQ ID NO: 6455 - DNA, 20 bp, Artificial
  20-mer unique DNA sequence
ctgctgcgggggctaaaatg

SEQ ID NO: 6456 - DNA, 20 bp, Artificial
  20-mer unique DNA sequence
gtctcggcacgcaattcagc

SEQ ID NO: 6457 - DNA, 20 bp, Artificial
  20-mer unique DNA sequence
tacggggcgcacaatctacg

SEQ ID NO: 6458 - DNA, 20 bp, Artificial
  20-mer unique DNA sequence
gacctccgcctgctcccact

SEQ ID NO: 6459 - DNA, 20 bp, Artificial
  20-mer unique DNA sequence
tcccctacctggccgttttg

SEQ ID NO: 6460 - DNA, 20 bp, Artificial
  20-mer unique DNA sequence
atcaccctgccacgctccat

SEQ ID NO: 6461 - DNA, 20 bp, Artificial
  20-mer unique DNA sequence
accacctcatgccacgtccg

SEQ ID NO: 6462 - DNA, 20 bp, Artificial
  20-mer unique DNA sequence
atgaagcgtgcctgtagggc

SEQ ID NO: 6463 - DNA, 20 bp, Artificial
  20-mer unique DNA sequence
tccgacgcgtgtgatcagga

SEQ ID NO: 6464 - DNA, 20 bp, Artificial
  20-mer unique DNA sequence
agaatgcgccgtagtgggga

SEQ ID NO: 6465 - DNA, 20 bp, Artificial
  20-mer unique DNA sequence
agacgctcattcccccgcag

SEQ ID NO: 6466 - DNA, 20 bp, Artificial
  20-mer unique DNA sequence
ttcggcgtctcatgggttcc

SEQ ID NO: 6467 - DNA, 20 bp, Artificial
  20-mer unique DNA sequence
ccaccgcgcctattgaacca

SEQ ID NO: 6468 - DNA, 20 bp, Artificial
  20-mer unique DNA sequence
cgctccatccaaaccgtcaa

SEQ ID NO: 6469 - DNA, 20 bp, Artificial
  20-mer unique DNA sequence
agaagctgcatgtgggcgca

SEQ ID NO: 6470 - DNA, 20 bp, Artificial
  20-mer unique DNA sequence
atgttagggggggcgtgggt

SEQ ID NO: 6471 - DNA, 20 bp, Artificial
  20-mer unique DNA sequence
cagcccccaacctcactgct

SEQ ID NO: 6472 - DNA, 20 bp, Artificial
  20-mer unique DNA sequence
ctgcaatggggggcactacc

SEQ ID NO: 6473 - DNA, 20 bp, Artificial
  20-mer unique DNA sequence
ctcaaatcccaaccccaccg

SEQ ID NO: 6474 - DNA, 20 bp, Artificial
  20-mer unique DNA sequence
ctcgcagcacacccccttca

SEQ ID NO: 6475 - DNA, 20 bp, Artificial
  20-mer unique DNA sequence
ataagagtggtcgccggggg

SEQ ID NO: 6476 - DNA, 20 bp, Artificial
  20-mer unique DNA sequence
cttcgggaggcaataggggg

SEQ ID NO: 6477 - DNA, 20 bp, Artificial
  20-mer unique DNA sequence
ctctggggggcatatgtggg

SEQ ID NO: 6478 - DNA, 20 bp, Artificial
  20-mer unique DNA sequence
atagctgatctgcggggcgg

SEQ ID NO: 6479 - DNA, 20 bp, Artificial
  20-mer unique DNA sequence
atgggcgcacaactcgaagc

SEQ ID NO: 6480 - DNA, 20 bp, Artificial
  20-mer unique DNA sequence
aaacccggccctgaaccatg

SEQ ID NO: 6481 - DNA, 20 bp, Artificial
  20-mer unique DNA sequence
ttggcggttgctctttggga

SEQ ID NO: 6482 - DNA, 20 bp, Artificial
  20-mer unique DNA sequence
gcgcgtgttttgctttgggg

SEQ ID NO: 6483 - DNA, 20 bp, Artificial
  20-mer unique DNA sequence
cggggaataggaaggagcgg

SEQ ID NO: 6484 - DNA, 20 bp, Artificial
  20-mer unique DNA sequence
agcctgcgtggaataagccg

SEQ ID NO: 6485 - DNA, 20 bp, Artificial
  20-mer unique DNA sequence
gatctggaggcgctggttgc

SEQ ID NO: 6486 - DNA, 20 bp, Artificial
  20-mer unique DNA sequence
cggcccacccccttgatcat

SEQ ID NO: 6487 - DNA, 20 bp, Artificial
  20-mer unique DNA sequence
cggcttcggtcgggttgatg

SEQ ID NO: 6488 - DNA, 20 bp, Artificial
  20-mer unique DNA sequence
tgaaggctgatgggcggtcc

SEQ ID NO: 6489 - DNA, 20 bp, Artificial
  20-mer unique DNA sequence
gggttcttgttgtccggggg

SEQ ID NO: 6490 - DNA, 20 bp, Artificial
  20-mer unique DNA sequence
agaccaccaggctgaaccga

SEQ ID NO: 6491 - DNA, 20 bp, Artificial
  20-mer unique DNA sequence
aggtcggactcatgtcacgc

SEQ ID NO: 6492 - DNA, 20 bp, Artificial
  20-mer unique DNA sequence
ttggcctgcagctagtctgg

SEQ ID NO: 6493 - DNA, 20 bp, Artificial
  20-mer unique DNA sequence
cacgcgatctagggtgagca

SEQ ID NO: 6494 - DNA, 20 bp, Artificial
  20-mer unique DNA sequence
ccgcaaccccatgaatgatg

SEQ ID NO: 6495 - DNA, 20 bp, Artificial
  20-mer unique DNA sequence
gccctggggttggggttaag

SEQ ID NO: 6496 - DNA, 20 bp, Artificial
  20-mer unique DNA sequence
cgactcccacgtgtgcccat

SEQ ID NO: 6497 - DNA, 20 bp, Artificial
  20-mer unique DNA sequence
tgcgcctcggtttcttctcc

SEQ ID NO: 6498 - DNA, 20 bp, Artificial
  20-mer unique DNA sequence
tggtgaagagggtacgcccg

SEQ ID NO: 6499 - DNA, 20 bp, Artificial
  20-mer unique DNA sequence
gagcaaatgaacgcgaggcg

SEQ ID NO: 6500 - DNA, 20 bp, Artificial
  20-mer unique DNA sequence
ccaaagactctgctcccgac

SEQ ID NO: 6501 - DNA, 20 bp, Artificial
  20-mer unique DNA sequence
acgcacaatccgaaaccccc

SEQ ID NO: 6502 - DNA, 20 bp, Artificial
  20-mer unique DNA sequence
gcgttgttccggaggcgtag

SEQ ID NO: 6503 - DNA, 20 bp, Artificial
  20-mer unique DNA sequence
gcggggaggaccaagaatga

SEQ ID NO: 6504 - DNA, 20 bp, Artificial
  20-mer unique DNA sequence
tggtaggagcgtgggggtga

SEQ ID NO: 6505 - DNA, 20 bp, Artificial
  20-mer unique DNA sequence
tgggcagatttgggcgagct

SEQ ID NO: 6506 - DNA, 20 bp, Artificial
  20-mer unique DNA sequence
cctgttcgccccttgcctcc

SEQ ID NO: 6507 - DNA, 20 bp, Artificial
  20-mer unique DNA sequence
cggcgggatgatgggatgac

SEQ ID NO: 6508 - DNA, 20 bp, Artificial
  20-mer unique DNA sequence
tccgcgcgttggccctatta

SEQ ID NO: 6509 - DNA, 20 bp, Artificial
  20-mer unique DNA sequence
gcgggggcttggattggtgt

SEQ ID NO: 6510 - DNA, 20 bp, Artificial
  20-mer unique DNA sequence
cgcgacgtttacccagtcct

SEQ ID NO: 6511 - DNA, 20 bp, Artificial
  20-mer unique DNA sequence
agaaccgcgacaggaacgca

SEQ ID NO: 6512 - DNA, 20 bp, Artificial
  20-mer unique DNA sequence
actgggcccggagcattacg

SEQ ID NO: 6513 - DNA, 20 bp, Artificial
  20-mer unique DNA sequence
ctccaaagcactgccgccgg

SEQ ID NO: 6514 - DNA, 20 bp, Artificial
  20-mer unique DNA sequence
tgtcctacgccctttcgcct

SEQ ID NO: 6515 - DNA, 20 bp, Artificial
  20-mer unique DNA sequence
ttttttttcggcttgcggct

SEQ ID NO: 6516 - DNA, 20 bp, Artificial
  20-mer unique DNA sequence
gagcgtgggcggagtggata

SEQ ID NO: 6517 - DNA, 20 bp, Artificial
  20-mer unique DNA sequence
tagccccaatcgcgaacacg

SEQ ID NO: 6518 - DNA, 20 bp, Artificial
  20-mer unique DNA sequence
gggcatgcgatcgaagggag

SEQ ID NO: 6519 - DNA, 20 bp, Artificial
  20-mer unique DNA sequence
acaatgggccggcagacagc

SEQ ID NO: 6520 - DNA, 20 bp, Artificial
  20-mer unique DNA sequence
tagcttgtcgggaggggcgt

SEQ ID NO: 6521 - DNA, 20 bp, Artificial
  20-mer unique DNA sequence
acgtggccggggttttcctc

SEQ ID NO: 6522 - DNA, 20 bp, Artificial
  20-mer unique DNA sequence
ccttggctcccatcgctttg

SEQ ID NO: 6523 - DNA, 20 bp, Artificial
  20-mer unique DNA sequence
gagggtcgtgggggtgctct

SEQ ID NO: 6524 - DNA, 20 bp, Artificial
  20-mer unique DNA sequence
ccagcaaccgccccaaatag

SEQ ID NO: 6525 - DNA, 20 bp, Artificial
  20-mer unique DNA sequence
caatgacggctgggcaagaa

SEQ ID NO: 6526 - DNA, 20 bp, Artificial
  20-mer unique DNA sequence
acccgtttgcatccctccct

SEQ ID NO: 6527 - DNA, 20 bp, Artificial
  20-mer unique DNA sequence
tgctcgccaattgatcgtcc

SEQ ID NO: 6528 - DNA, 20 bp, Artificial
  20-mer unique DNA sequence
ctcccgcaccagaaccgtcc

SEQ ID NO: 6529 - DNA, 20 bp, Artificial
  20-mer unique DNA sequence
tacaagtcgtggtcggggcc

SEQ ID NO: 6530 - DNA, 20 bp, Artificial
  20-mer unique DNA sequence
gggcagcgggaagcaattaa

SEQ ID NO: 6531 - DNA, 20 bp, Artificial
  20-mer unique DNA sequence
ggcatgaccctaactcggcg

SEQ ID NO: 6532 - DNA, 20 bp, Artificial
  20-mer unique DNA sequence
cctaaggggcgagaccggtc

SEQ ID NO: 6533 - DNA, 20 bp, Artificial
  20-mer unique DNA sequence
agcgcggccatcctagacat

SEQ ID NO: 6534 - DNA, 20 bp, Artificial
  20-mer unique DNA sequence
cctccaccccacactccgtt

SEQ ID NO: 6535 - DNA, 20 bp, Artificial
  20-mer unique DNA sequence
ggtaattgatggcgggctgg

SEQ ID NO: 6536 - DNA, 20 bp, Artificial
  20-mer unique DNA sequence
gacttatggacggcaccgcg

SEQ ID NO: 6537 - DNA, 20 bp, Artificial
  20-mer unique DNA sequence
ccttggtggcgggtctgtca

SEQ ID NO: 6538 - DNA, 20 bp, Artificial
  20-mer unique DNA sequence
tgcgcataccaaccggaaca

SEQ ID NO: 6539 - DNA, 20 bp, Artificial
  20-mer unique DNA sequence
gctttgcttggcggggttta

SEQ ID NO: 6540 - DNA, 20 bp, Artificial
  20-mer unique DNA sequence
cagccacactaaagcgccga

SEQ ID NO: 6541 - DNA, 20 bp, Artificial
  20-mer unique DNA sequence
cacacctcgggcgcctttaa

SEQ ID NO: 6542 - DNA, 20 bp, Artificial
  20-mer unique DNA sequence
accccgctttcaatccgtcg

SEQ ID NO: 6543 - DNA, 20 bp, Artificial
  20-mer unique DNA sequence
aactcctcccggtctcgcaa

SEQ ID NO: 6544 - DNA, 20 bp, Artificial
  20-mer unique DNA sequence
agcccaaacgtagcacccgc

SEQ ID NO: 6545 - DNA, 20 bp, Artificial
  20-mer unique DNA sequence
ttctgatagggggaggcgca

SEQ ID NO: 6546 - DNA, 20 bp, Artificial
  20-mer unique DNA sequence
gttcatgcccgtttcgccca

SEQ ID NO: 6547 - DNA, 20 bp, Artificial
  20-mer unique DNA sequence
acctcccctcaagttccgcc

SEQ ID NO: 6548 - DNA, 20 bp, Artificial
  20-mer unique DNA sequence
tccacgcaaaacctcgcctt

SEQ ID NO: 6549 - DNA, 20 bp, Artificial
  20-mer unique DNA sequence
cggaatacgctgggagtgca

SEQ ID NO: 6550 - DNA, 20 bp, Artificial
  20-mer unique DNA sequence
agtgttgcgaggcggaggaa

SEQ ID NO: 6551 - DNA, 20 bp, Artificial
  20-mer unique DNA sequence
tcacctttttgtggggcggt

SEQ ID NO: 6552 - DNA, 20 bp, Artificial
  20-mer unique DNA sequence
ttaccgcccggccactctca

SEQ ID NO: 6553 - DNA, 20 bp, Artificial
  20-mer unique DNA sequence
tttgtccattccccgagcct

SEQ ID NO: 6554 - DNA, 20 bp, Artificial
  20-mer unique DNA sequence
gcgagtaaagccccgattgg

SEQ ID NO: 6555 - DNA, 20 bp, Artificial
  20-mer unique DNA sequence
ggagctatggcgacttgggg

SEQ ID NO: 6556 - DNA, 20 bp, Artificial
  20-mer unique DNA sequence
ccagccacgttttccccctt

SEQ ID NO: 6557 - DNA, 20 bp, Artificial
  20-mer unique DNA sequence
cacgcgcacctttccacact

SEQ ID NO: 6558 - DNA, 20 bp, Artificial
  20-mer unique DNA sequence
ttctcgctgctcgcttccgt

SEQ ID NO: 6559 - DNA, 20 bp, Artificial
  20-mer unique DNA sequence
ctcggctccctcccgtgtta

SEQ ID NO: 6560 - DNA, 20 bp, Artificial
  20-mer unique DNA sequence
acggtgatagagacgggcgc

SEQ ID NO: 6561 - DNA, 20 bp, Artificial
  20-mer unique DNA sequence
tggccggacgaggtaatgga

SEQ ID NO: 6562 - DNA, 20 bp, Artificial
  20-mer unique DNA sequence
ctgcctgccccactctcggt

SEQ ID NO: 6563 - DNA, 20 bp, Artificial
  20-mer unique DNA sequence
gctgcgtggaggggggtagt

SEQ ID NO: 6564 - DNA, 20 bp, Artificial
  20-mer unique DNA sequence
gtgtgcgtgctggggatgtg

SEQ ID NO: 6565 - DNA, 20 bp, Artificial
  20-mer unique DNA sequence
gaggcaacggacgcgaagaa

SEQ ID NO: 6566 - DNA, 20 bp, Artificial
  20-mer unique DNA sequence
gaagcggcaagacgacaggc

SEQ ID NO: 6567 - DNA, 20 bp, Artificial
  20-mer unique DNA sequence
aagtcgaactggaacgaggc

SEQ ID NO: 6568 - DNA, 20 bp, Artificial
  20-mer unique DNA sequence
cccgatacccccccacgtct

SEQ ID NO: 6569 - DNA, 20 bp, Artificial
  20-mer unique DNA sequence
tccgcccccaaaccctactc

SEQ ID NO: 6570 - DNA, 20 bp, Artificial
  20-mer unique DNA sequence
atgatgaaggcccacccgcc

SEQ ID NO: 6571 - DNA, 20 bp, Artificial
  20-mer unique DNA sequence
acctgtcacccgctgccctc

SEQ ID NO: 6572 - DNA, 20 bp, Artificial
  20-mer unique DNA sequence
gccaatatgtgccctcccgc

SEQ ID NO: 6573 - DNA, 20 bp, Artificial
  20-mer unique DNA sequence
ggaccgcgagtatgcatgcg

SEQ ID NO: 6574 - DNA, 20 bp, Artificial
  20-mer unique DNA sequence
cgttccgctgctcgtggctg

SEQ ID NO: 6575 - DNA, 20 bp, Artificial
  20-mer unique DNA sequence
actgatatgcccccgtcccc

SEQ ID NO: 6576 - DNA, 20 bp, Artificial
  20-mer unique DNA sequence
ggcaacaaacgcgacatggc

SEQ ID NO: 6577 - DNA, 20 bp, Artificial
  20-mer unique DNA sequence
cctgcttgttccgtcccaca

SEQ ID NO: 6578 - DNA, 20 bp, Artificial
  20-mer unique DNA sequence
cgcttaagccgtttggcgaa

SEQ ID NO: 6579 - DNA, 20 bp, Artificial
  20-mer unique DNA sequence
cgattaatgccccgttccca

SEQ ID NO: 6580 - DNA, 20 bp, Artificial
  20-mer unique DNA sequence
aattgaacagaccccccgcc

SEQ ID NO: 6581 - DNA, 20 bp, Artificial
  20-mer unique DNA sequence
tttcccagcacagacccgag

SEQ ID NO: 6582 - DNA, 20 bp, Artificial
  20-mer unique DNA sequence
tccaccgccactccagcaat

SEQ ID NO: 6583 - DNA, 20 bp, Artificial
  20-mer unique DNA sequence
gcgggttgtggctttgctgc

SEQ ID NO: 6584 - DNA, 20 bp, Artificial
  20-mer unique DNA sequence
ccgcaaacaaggaccagggg

SEQ ID NO: 6585 - DNA, 20 bp, Artificial
  20-mer unique DNA sequence
gccatctcgtgccgcgttaa

SEQ ID NO: 6586 - DNA, 20 bp, Artificial
  20-mer unique DNA sequence
cgttaggactgcgtgggctg

SEQ ID NO: 6587 - DNA, 20 bp, Artificial
  20-mer unique DNA sequence
tgggagcggcatgttggaag

SEQ ID NO: 6588 - DNA, 20 bp, Artificial
  20-mer unique DNA sequence
ccaaagcagcaaaggggcac

SEQ ID NO: 6589 - DNA, 20 bp, Artificial
  20-mer unique DNA sequence
atgggcagttggtgaggcgc

SEQ ID NO: 6590 - DNA, 20 bp, Artificial
  20-mer unique DNA sequence
tcactcatcccagcacgccg

SEQ ID NO: 6591 - DNA, 20 bp, Artificial
  20-mer unique DNA sequence
caagaccaggggccgttcac

SEQ ID NO: 6592 - DNA, 20 bp, Artificial
  20-mer unique DNA sequence
gtgttttgcggctccagggt

SEQ ID NO: 6593 - DNA, 20 bp, Artificial
  20-mer unique DNA sequence
cccatacgcacctccgaccg

SEQ ID NO: 6594 - DNA, 20 bp, Artificial
  20-mer unique DNA sequence
gacgacggtgtacgggtaga

SEQ ID NO: 6595 - DNA, 20 bp, Artificial
  20-mer unique DNA sequence
agaaggtgggcaacggcgaa

SEQ ID NO: 6596 - DNA, 20 bp, Artificial
  20-mer unique DNA sequence
cgacgcaagacggggaacag

SEQ ID NO: 6597 - DNA, 20 bp, Artificial
  20-mer unique DNA sequence
cccctggtcttcgcgtgcta

SEQ ID NO: 6598 - DNA, 20 bp, Artificial
  20-mer unique DNA sequence
atcacgctcccaagatcccg

SEQ ID NO: 6599 - DNA, 20 bp, Artificial
  20-mer unique DNA sequence
ccccaaatcgatcgctcctg

SEQ ID NO: 6600 - DNA, 20 bp, Artificial
  20-mer unique DNA sequence
aacttggtgcgtggcgggac

SEQ ID NO: 6601 - DNA, 20 bp, Artificial
  20-mer unique DNA sequence
cgccaaatccgctccagtgt

SEQ ID NO: 6602 - DNA, 20 bp, Artificial
  20-mer unique DNA sequence
aaggtcccagccccccgaag

SEQ ID NO: 6603 - DNA, 20 bp, Artificial
  20-mer unique DNA sequence
caggaaaccccgacacgatg

SEQ ID NO: 6604 - DNA, 20 bp, Artificial
  20-mer unique DNA sequence
tccagcccctgttgcctccc

SEQ ID NO: 6605 - DNA, 20 bp, Artificial
  20-mer unique DNA sequence
gccgcgaagtggacgcttat

SEQ ID NO: 6606 - DNA, 20 bp, Artificial
  20-mer unique DNA sequence
gcacgtcatcgggcattacg

SEQ ID NO: 6607 - DNA, 20 bp, Artificial
  20-mer unique DNA sequence
catgcacactaggccacgga

SEQ ID NO: 6608 - DNA, 20 bp, Artificial
  20-mer unique DNA sequence
atgagacctaaccgcccccg

SEQ ID NO: 6609 - DNA, 20 bp, Artificial
  20-mer unique DNA sequence
ccttccaccccctgacgatg

SEQ ID NO: 6610 - DNA, 20 bp, Artificial
  20-mer unique DNA sequence
aaccgaaaggaaggcgggag

SEQ ID NO: 6611 - DNA, 20 bp, Artificial
  20-mer unique DNA sequence
tgccctaggtgctagatgcg

SEQ ID NO: 6612 - DNA, 20 bp, Artificial
  20-mer unique DNA sequence
tccgggccttttcgatcttg

SEQ ID NO: 6613 - DNA, 20 bp, Artificial
  20-mer unique DNA sequence
aggtgcgcggtttccatgat

SEQ ID NO: 6614 - DNA, 20 bp, Artificial
  20-mer unique DNA sequence
tttttgcaggagggcgcttt

SEQ ID NO: 6615 - DNA, 20 bp, Artificial
  20-mer unique DNA sequence
cgggtcttaggcgtggggga

SEQ ID NO: 6616 - DNA, 20 bp, Artificial
  20-mer unique DNA sequence
gattgagtgggggtggcgac

SEQ ID NO: 6617 - DNA, 20 bp, Artificial
  20-mer unique DNA sequence
tgcaaagggatcccgggagg

SEQ ID NO: 6618 - DNA, 20 bp, Artificial
  20-mer unique DNA sequence
cagttcacgatgggcgagca

SEQ ID NO: 6619 - DNA, 20 bp, Artificial
  20-mer unique DNA sequence
tcccgcatccccttgcacat

SEQ ID NO: 6620 - DNA, 20 bp, Artificial
  20-mer unique DNA sequence
cgcgtggtggagttctttgt

SEQ ID NO: 6621 - DNA, 20 bp, Artificial
  20-mer unique DNA sequence
gtcggggatgttcgggattg

SEQ ID NO: 6622 - DNA, 20 bp, Artificial
  20-mer unique DNA sequence
agacgggcctttgttgctga

SEQ ID NO: 6623 - DNA, 20 bp, Artificial
  20-mer unique DNA sequence
aacattcgaaaccgcccccg

SEQ ID NO: 6624 - DNA, 20 bp, Artificial
  20-mer unique DNA sequence
cgtgatcccgaagcaacccg

SEQ ID NO: 6625 - DNA, 20 bp, Artificial
  20-mer unique DNA sequence
gccctgtcttgacttccgcc

SEQ ID NO: 6626 - DNA, 20 bp, Artificial
  20-mer unique DNA sequence
catcgggtagaaggcggctg

SEQ ID NO: 6627 - DNA, 20 bp, Artificial
  20-mer unique DNA sequence
gccctcctgcccaatccatc

SEQ ID NO: 6628 - DNA, 20 bp, Artificial
  20-mer unique DNA sequence
gacgcccccgcaaagatagg

SEQ ID NO: 6629 - DNA, 20 bp, Artificial
  20-mer unique DNA sequence
gaaagcccaaagctcacccg

SEQ ID NO: 6630 - DNA, 20 bp, Artificial
  20-mer unique DNA sequence
attgcccccatagtccgccc

SEQ ID NO: 6631 - DNA, 20 bp, Artificial
  20-mer unique DNA sequence
ttaggcgggattggcggaaa

SEQ ID NO: 6632 - DNA, 20 bp, Artificial
  20-mer unique DNA sequence
gtcggtcgtggggggtcaat

SEQ ID NO: 6633 - DNA, 20 bp, Artificial
  20-mer unique DNA sequence
gcaaggaaggagggggggtg

SEQ ID NO: 6634 - DNA, 20 bp, Artificial
  20-mer unique DNA sequence
aacatcccgccccactgaag

SEQ ID NO: 6635 - DNA, 20 bp, Artificial
  20-mer unique DNA sequence
accttcgcggccccttgttg

SEQ ID NO: 6636 - DNA, 20 bp, Artificial
  20-mer unique DNA sequence
taaaccgccgcaaaaccgca

SEQ ID NO: 6637 - DNA, 20 bp, Artificial
  20-mer unique DNA sequence
ttgttgttctggtcgggccc

SEQ ID NO: 6638 - DNA, 20 bp, Artificial
  20-mer unique DNA sequence
ctgttgcccgattagcccga

SEQ ID NO: 6639 - DNA, 20 bp, Artificial
  20-mer unique DNA sequence
cacgtccaggccaataccgc

SEQ ID NO: 6640 - DNA, 20 bp, Artificial
  20-mer unique DNA sequence
tggcgacggggatgaactga

SEQ ID NO: 6641 - DNA, 20 bp, Artificial
  20-mer unique DNA sequence
atgcgaaacccgatgaacgc

SEQ ID NO: 6642 - DNA, 20 bp, Artificial
  20-mer unique DNA sequence
acgggcgaggaacgaacgac

SEQ ID NO: 6643 - DNA, 20 bp, Artificial
  20-mer unique DNA sequence
ctgcgggtgaacttttggcg

SEQ ID NO: 6644 - DNA, 20 bp, Artificial
  20-mer unique DNA sequence
ggaggtggaggacatggcgt

SEQ ID NO: 6645 - DNA, 20 bp, Artificial
  20-mer unique DNA sequence
gggctgttggggcgactgat

SEQ ID NO: 6646 - DNA, 20 bp, Artificial
  20-mer unique DNA sequence
gatgcggggtgccaaggaga

SEQ ID NO: 6647 - DNA, 20 bp, Artificial
  20-mer unique DNA sequence
cccatccgcccacccaaagt

SEQ ID NO: 6648 - DNA, 20 bp, Artificial
  20-mer unique DNA sequence
cgacatcaggcgcccacaac

SEQ ID NO: 6649 - DNA, 20 bp, Artificial
  20-mer unique DNA sequence
agccatacacccgacgaccg

SEQ ID NO: 6650 - DNA, 20 bp, Artificial
  20-mer unique DNA sequence
cctcgcaatccgcaaagaca

SEQ ID NO: 6651 - DNA, 20 bp, Artificial
  20-mer unique DNA sequence
tgcgatgcggtttcaggttg

SEQ ID NO: 6652 - DNA, 20 bp, Artificial
  20-mer unique DNA sequence
tccgctcccccatccttaag

SEQ ID NO: 6653 - DNA, 20 bp, Artificial
  20-mer unique DNA sequence
ttgggaagcggacgacgagg

SEQ ID NO: 6654 - DNA, 20 bp, Artificial
  20-mer unique DNA sequence
cgccagaggtacagcggagg

SEQ ID NO: 6655 - DNA, 20 bp, Artificial
  20-mer unique DNA sequence
agacttccccatgccccgcg

SEQ ID NO: 6656 - DNA, 20 bp, Artificial
  20-mer unique DNA sequence
ccgcgccacgactaaaggct

SEQ ID NO: 6657 - DNA, 20 bp, Artificial
  20-mer unique DNA sequence
ccacaatcggacgcgagcat

SEQ ID NO: 6658 - DNA, 20 bp, Artificial
  20-mer unique DNA sequence
acactggcgggaggagcatt

SEQ ID NO: 6659 - DNA, 20 bp, Artificial
  20-mer unique DNA sequence
gccgggactgaagggtgcat

SEQ ID NO: 6660 - DNA, 20 bp, Artificial
  20-mer unique DNA sequence
cccggtcgtaagtggcatgc

SEQ ID NO: 6661 - DNA, 20 bp, Artificial
  20-mer unique DNA sequence
cgacgctagaaggatagcga

SEQ ID NO: 6662 - DNA, 20 bp, Artificial
  20-mer unique DNA sequence
cggcggcaattaatacgaca

SEQ ID NO: 6663 - DNA, 20 bp, Artificial
  20-mer unique DNA sequence
caagcgcacaaaagggaacg

SEQ ID NO: 6664 - DNA, 20 bp, Artificial
  20-mer unique DNA sequence
agggagtatggccacgcgac

SEQ ID NO: 6665 - DNA, 20 bp, Artificial
  20-mer unique DNA sequence
gccccgcattttcattctcg

SEQ ID NO: 6666 - DNA, 20 bp, Artificial
  20-mer unique DNA sequence
agctccccgtgcttaaccct

SEQ ID NO: 6667 - DNA, 20 bp, Artificial
  20-mer unique DNA sequence
ttcaccccggccatctgcag

SEQ ID NO: 6668 - DNA, 20 bp, Artificial
  20-mer unique DNA sequence
gttggcagggagcgcgttct

SEQ ID NO: 6669 - DNA, 20 bp, Artificial
  20-mer unique DNA sequence
tggtgccctttcggttcgct

SEQ ID NO: 6670 - DNA, 20 bp, Artificial
  20-mer unique DNA sequence
acccccgacagagcaacacc

SEQ ID NO: 6671 - DNA, 20 bp, Artificial
  20-mer unique DNA sequence
tgcccacacatcgtcccaat

SEQ ID NO: 6672 - DNA, 20 bp, Artificial
  20-mer unique DNA sequence
ggctcttgcggcttttgcct

SEQ ID NO: 6673 - DNA, 20 bp, Artificial
  20-mer unique DNA sequence
caaaaggacacggagcccca

SEQ ID NO: 6674 - DNA, 20 bp, Artificial
  20-mer unique DNA sequence
aacccagcccaatgtcaccc

SEQ ID NO: 6675 - DNA, 20 bp, Artificial
  20-mer unique DNA sequence
ggggggcgtggaggactatg

SEQ ID NO: 6676 - DNA, 20 bp, Artificial
  20-mer unique DNA sequence
gagacgcacattcgagcaaa

SEQ ID NO: 6677 - DNA, 20 bp, Artificial
  20-mer unique DNA sequence
tgagggctggtgatttggca

SEQ ID NO: 6678 - DNA, 20 bp, Artificial
  20-mer unique DNA sequence
gtcgtaaccggtccaccact

SEQ ID NO: 6679 - DNA, 20 bp, Artificial
  20-mer unique DNA sequence
atcgttgtccgcagtgcctg

SEQ ID NO: 6680 - DNA, 20 bp, Artificial
  20-mer unique DNA sequence
aagaggaggcggagcgaggc

SEQ ID NO: 6681 - DNA, 20 bp, Artificial
  20-mer unique DNA sequence
tcccccgttattcatccgcc

SEQ ID NO: 6682 - DNA, 20 bp, Artificial
  20-mer unique DNA sequence
tgaatcgtgagctgcgcgaa

SEQ ID NO: 6683 - DNA, 20 bp, Artificial
  20-mer unique DNA sequence
cggataagcccgccagagca

SEQ ID NO: 6684 - DNA, 20 bp, Artificial
  20-mer unique DNA sequence
gtgctgcttgcggctgctgt

SEQ ID NO: 6685 - DNA, 20 bp, Artificial
  20-mer unique DNA sequence
gaggagcgcccccacgagat

SEQ ID NO: 6686 - DNA, 20 bp, Artificial
  20-mer unique DNA sequence
tgcgggcgagagggagtaat

SEQ ID NO: 6687 - DNA, 20 bp, Artificial
  20-mer unique DNA sequence
cagacgcacccatatcccgg

SEQ ID NO: 6688 - DNA, 20 bp, Artificial
  20-mer unique DNA sequence
ttgggcgcacccgtaggata

SEQ ID NO: 6689 - DNA, 20 bp, Artificial
  20-mer unique DNA sequence
tgtggtgccccgtaagtgga

SEQ ID NO: 6690 - DNA, 20 bp, Artificial
  20-mer unique DNA sequence
cctcagtgccattcccccca

SEQ ID NO: 6691 - DNA, 20 bp, Artificial
  20-mer unique DNA sequence
aagggtgggtcgatgcgttc

SEQ ID NO: 6692 - DNA, 20 bp, Artificial
  20-mer unique DNA sequence
tccacacatgcaagcccacg

SEQ ID NO: 6693 - DNA, 20 bp, Artificial
  20-mer unique DNA sequence
cacgaccccagccgcaagat

SEQ ID NO: 6694 - DNA, 20 bp, Artificial
  20-mer unique DNA sequence
gaacgttgggcgcggtaaaa

SEQ ID NO: 6695 - DNA, 20 bp, Artificial
  20-mer unique DNA sequence
aacacccttccagccaccgc

SEQ ID NO: 6696 - DNA, 20 bp, Artificial
  20-mer unique DNA sequence
agccatacgagggggggaag

SEQ ID NO: 6697 - DNA, 20 bp, Artificial
  20-mer unique DNA sequence
tcccctttcacccgagccag

SEQ ID NO: 6698 - DNA, 20 bp, Artificial
  20-mer unique DNA sequence
cgggagggctgggatcgaag

SEQ ID NO: 6699 - DNA, 20 bp, Artificial
  20-mer unique DNA sequence
agtcccctctgcatagcgcg

SEQ ID NO: 6700 - DNA, 20 bp, Artificial
  20-mer unique DNA sequence
tcgggatatttggcagcgtg

SEQ ID NO: 6701 - DNA, 20 bp, Artificial
  20-mer unique DNA sequence
acaagagcaccccggaacga

SEQ ID NO: 6702 - DNA, 20 bp, Artificial
  20-mer unique DNA sequence
cggcgtcgcgtataggcaga

SEQ ID NO: 6703 - DNA, 20 bp, Artificial
  20-mer unique DNA sequence
gcgacgctacaacatcggga

SEQ ID NO: 6704 - DNA, 20 bp, Artificial
  20-mer unique DNA sequence
cagagagatgtgcccccccg

SEQ ID NO: 6705 - DNA, 20 bp, Artificial
  20-mer unique DNA sequence
ggtacgtccgctctcgccgt

SEQ ID NO: 6706 - DNA, 20 bp, Artificial
  20-mer unique DNA sequence
tttgctccgccaccgtccac

SEQ ID NO: 6707 - DNA, 20 bp, Artificial
  20-mer unique DNA sequence
aagcaaacgagagccgagcg

SEQ ID NO: 6708 - DNA, 20 bp, Artificial
  20-mer unique DNA sequence
cagccccacccgagaagaac

SEQ ID NO: 6709 - DNA, 20 bp, Artificial
  20-mer unique DNA sequence
gcggggaacggaatagacgg

SEQ ID NO: 6710 - DNA, 20 bp, Artificial
  20-mer unique DNA sequence
gtgtgtgaggatccggccga

SEQ ID NO: 6711 - DNA, 20 bp, Artificial
  20-mer unique DNA sequence
ttctctggacgggccgtgat

SEQ ID NO: 6712 - DNA, 20 bp, Artificial
  20-mer unique DNA sequence
cccgaagcgccaaacctggg

SEQ ID NO: 6713 - DNA, 20 bp, Artificial
  20-mer unique DNA sequence
ccgcacgccgacactctcac

SEQ ID NO: 6714 - DNA, 20 bp, Artificial
  20-mer unique DNA sequence
agaggccgtggcgatgagtc

SEQ ID NO: 6715 - DNA, 20 bp, Artificial
  20-mer unique DNA sequence
cttgctcgctgcacggttcc

SEQ ID NO: 6716 - DNA, 20 bp, Artificial
  20-mer unique DNA sequence
cgggatcatttgggcctttg

SEQ ID NO: 6717 - DNA, 20 bp, Artificial
  20-mer unique DNA sequence
acctgtacgccccacctcga

SEQ ID NO: 6718 - DNA, 20 bp, Artificial
  20-mer unique DNA sequence
cgcgagaacgagccaacagc

SEQ ID NO: 6719 - DNA, 20 bp, Artificial
  20-mer unique DNA sequence
tcaggcaggcacacggacat

SEQ ID NO: 6720 - DNA, 20 bp, Artificial
  20-mer unique DNA sequence
tctgcctcccctcacccacc

SEQ ID NO: 6721 - DNA, 20 bp, Artificial
  20-mer unique DNA sequence
gcaagcggagacgggaacga

SEQ ID NO: 6722 - DNA, 20 bp, Artificial
  20-mer unique DNA sequence
cacccaacccccagcagcag

SEQ ID NO: 6723 - DNA, 20 bp, Artificial
  20-mer unique DNA sequence
aacgccgaaaggacgggaca

SEQ ID NO: 6724 - DNA, 20 bp, Artificial
  20-mer unique DNA sequence
gaaccaatagggccctgcca

SEQ ID NO: 6725 - DNA, 20 bp, Artificial
  20-mer unique DNA sequence
tccgggctgcgtactcactg

SEQ ID NO: 6726 - DNA, 20 bp, Artificial
  20-mer unique DNA sequence
ccccgaacgaattagaccgc

SEQ ID NO: 6727 - DNA, 20 bp, Artificial
  20-mer unique DNA sequence
acgcccctcgagcacatgtg

SEQ ID NO: 6728 - DNA, 20 bp, Artificial
  20-mer unique DNA sequence
tcccaggtcatccccgttga

SEQ ID NO: 6729 - DNA, 20 bp, Artificial
  20-mer unique DNA sequence
cggcgcgtagcgtaaacgat

SEQ ID NO: 6730 - DNA, 20 bp, Artificial
  20-mer unique DNA sequence
ctttcggttgcggatttcgg

SEQ ID NO: 6731 - DNA, 20 bp, Artificial
  20-mer unique DNA sequence
tcgcgttttgggtcggttca

SEQ ID NO: 6732 - DNA, 20 bp, Artificial
  20-mer unique DNA sequence
ccgtgccccccatcagctta

SEQ ID NO: 6733 - DNA, 20 bp, Artificial
  20-mer unique DNA sequence
cgaaccgaacgaaatcgcag

SEQ ID NO: 6734 - DNA, 20 bp, Artificial
  20-mer unique DNA sequence
tagccccccaggcgttcagg

SEQ ID NO: 6735 - DNA, 20 bp, Artificial
  20-mer unique DNA sequence
gcgtgggggtctgtgagtga

SEQ ID NO: 6736 - DNA, 20 bp, Artificial
  20-mer unique DNA sequence
tggggcggacagcaaacatc

SEQ ID NO: 6737 - DNA, 20 bp, Artificial
  20-mer unique DNA sequence
cgccttctttgatgctcggg

SEQ ID NO: 6738 - DNA, 20 bp, Artificial
  20-mer unique DNA sequence
agggactaggggtgctgggg

SEQ ID NO: 6739 - DNA, 20 bp, Artificial
  20-mer unique DNA sequence
atgacaacccgcgactccca

SEQ ID NO: 6740 - DNA, 20 bp, Artificial
  20-mer unique DNA sequence
cccagtgcccctcccagtaa

SEQ ID NO: 6741 - DNA, 20 bp, Artificial
  20-mer unique DNA sequence
gttcgtcgccctgcatccct

SEQ ID NO: 6742 - DNA, 20 bp, Artificial
  20-mer unique DNA sequence
tcctcgcgcaaaccgtacca

SEQ ID NO: 6743 - DNA, 20 bp, Artificial
  20-mer unique DNA sequence
gttgcacaggagccaggggt

SEQ ID NO: 6744 - DNA, 20 bp, Artificial
  20-mer unique DNA sequence
acgtgtccggttggactcag

SEQ ID NO: 6745 - DNA, 20 bp, Artificial
  20-mer unique DNA sequence
attcgagctacggcacggtt

SEQ ID NO: 6746 - DNA, 20 bp, Artificial
  20-mer unique DNA sequence
ggtgtaaattgggcgggcga

SEQ ID NO: 6747 - DNA, 20 bp, Artificial
  20-mer unique DNA sequence
cggggtctcggcggtgttct

SEQ ID NO: 6748 - DNA, 20 bp, Artificial
  20-mer unique DNA sequence
gcactgaggcgtcctgatga

SEQ ID NO: 6749 - DNA, 20 bp, Artificial
  20-mer unique DNA sequence
tcacatcgcgctgcgtacaa

SEQ ID NO: 6750 - DNA, 20 bp, Artificial
  20-mer unique DNA sequence
cgcgttgatccctctcgtgc

SEQ ID NO: 6751 - DNA, 20 bp, Artificial
  20-mer unique DNA sequence
tgggtgcgagacgatggagc

SEQ ID NO: 6752 - DNA, 20 bp, Artificial
  20-mer unique DNA sequence
cggcgaagaccaaagacgtg

SEQ ID NO: 6753 - DNA, 20 bp, Artificial
  20-mer unique DNA sequence
cgctccccgtccctatgtga

SEQ ID NO: 6754 - DNA, 20 bp, Artificial
  20-mer unique DNA sequence
tcggcgccccaaagagacta

SEQ ID NO: 6755 - DNA, 20 bp, Artificial
  20-mer unique DNA sequence
cgcggtctgtttccaagtgc

SEQ ID NO: 6756 - DNA, 20 bp, Artificial
  20-mer unique DNA sequence
cgttgggggccggtagaaaa

SEQ ID NO: 6757 - DNA, 20 bp, Artificial
  20-mer unique DNA sequence
ccccgcccagccgtagataa

SEQ ID NO: 6758 - DNA, 20 bp, Artificial
  20-mer unique DNA sequence
ggggctttcctggtcgactg

SEQ ID NO: 6759 - DNA, 20 bp, Artificial
  20-mer unique DNA sequence
aaagctctccccattcggcc

SEQ ID NO: 6760 - DNA, 20 bp, Artificial
  20-mer unique DNA sequence
cagatcccacgcacgcacag

SEQ ID NO: 6761 - DNA, 20 bp, Artificial
  20-mer unique DNA sequence
acacccccaaacgactgccg

SEQ ID NO: 6762 - DNA, 20 bp, Artificial
  20-mer unique DNA sequence
agtactggccttaggcacgc

SEQ ID NO: 6763 - DNA, 20 bp, Artificial
  20-mer unique DNA sequence
cggtacaccgtgcgacgttt

SEQ ID NO: 6764 - DNA, 20 bp, Artificial
  20-mer unique DNA sequence
ccgctcctcggaatttgcat

SEQ ID NO: 6765 - DNA, 20 bp, Artificial
  20-mer unique DNA sequence
gtcaagccccgagcagcaag

SEQ ID NO: 6766 - DNA, 20 bp, Artificial
  20-mer unique DNA sequence
agagcagacgagcggggcca

SEQ ID NO: 6767 - DNA, 20 bp, Artificial
  20-mer unique DNA sequence
aggcggcgggaatgtttagg

SEQ ID NO: 6768 - DNA, 20 bp, Artificial
  20-mer unique DNA sequence
aactcctcgcggcttgacgc

SEQ ID NO: 6769 - DNA, 20 bp, Artificial
  20-mer unique DNA sequence
ctcccggccatacttgctcc

SEQ ID NO: 6770 - DNA, 20 bp, Artificial
  20-mer unique DNA sequence
acagcctacaagcccgccag

SEQ ID NO: 6771 - DNA, 20 bp, Artificial
  20-mer unique DNA sequence
tgcccgctaagaacacaccg

SEQ ID NO: 6772 - DNA, 20 bp, Artificial
  20-mer unique DNA sequence
gggttgggacctgggacgct

SEQ ID NO: 6773 - DNA, 20 bp, Artificial
  20-mer unique DNA sequence
cacctgctgcccttcgtctg

SEQ ID NO: 6774 - DNA, 20 bp, Artificial
  20-mer unique DNA sequence
ttgtatggcccgaggtaggc

SEQ ID NO: 6775 - DNA, 20 bp, Artificial
  20-mer unique DNA sequence
cctagcgccccgatcacaag

SEQ ID NO: 6776 - DNA, 20 bp, Artificial
  20-mer unique DNA sequence
gccagcgaacaggggctaac

SEQ ID NO: 6777 - DNA, 20 bp, Artificial
  20-mer unique DNA sequence
cgtgagcatatggggcgatg

SEQ ID NO: 6778 - DNA, 20 bp, Artificial
  20-mer unique DNA sequence
cgctgtttgtgccggagaga

SEQ ID NO: 6779 - DNA, 20 bp, Artificial
  20-mer unique DNA sequence
ctgtcctcatccgcgtcttg

SEQ ID NO: 6780 - DNA, 20 bp, Artificial
  20-mer unique DNA sequence
cgccgcgctggataacatct

SEQ ID NO: 6781 - DNA, 20 bp, Artificial
  20-mer unique DNA sequence
ggactccggtaaacgccact

SEQ ID NO: 6782 - DNA, 20 bp, Artificial
  20-mer unique DNA sequence
gcccggctacaacgcaactt

SEQ ID NO: 6783 - DNA, 20 bp, Artificial
  20-mer unique DNA sequence
acctgtaagcgcccgacgaa

SEQ ID NO: 6784 - DNA, 20 bp, Artificial
  20-mer unique DNA sequence
gccggcgatcgtcaaaaaga

SEQ ID NO: 6785 - DNA, 20 bp, Artificial
  20-mer unique DNA sequence
gccacagcacccctttaccg

SEQ ID NO: 6786 - DNA, 20 bp, Artificial
  20-mer unique DNA sequence
gcgcctcgagacacaccaca

SEQ ID NO: 6787 - DNA, 20 bp, Artificial
  20-mer unique DNA sequence
ctggggggtcctgctttctg

SEQ ID NO: 6788 - DNA, 20 bp, Artificial
  20-mer unique DNA sequence
cgggaccggctggaatttga

SEQ ID NO: 6789 - DNA, 20 bp, Artificial
  20-mer unique DNA sequence
tgcaacccggctggatcttt

SEQ ID NO: 6790 - DNA, 20 bp, Artificial
  20-mer unique DNA sequence
tagtgaggggcaggcggatg

SEQ ID NO: 6791 - DNA, 20 bp, Artificial
  20-mer unique DNA sequence
gcgacggcggactgggttag

SEQ ID NO: 6792 - DNA, 20 bp, Artificial
  20-mer unique DNA sequence
cacacggtccagacctggtt

SEQ ID NO: 6793 - DNA, 20 bp, Artificial
  20-mer unique DNA sequence
atgggtcacagtgcgacgtg

SEQ ID NO: 6794 - DNA, 20 bp, Artificial
  20-mer unique DNA sequence
tccgagacgtccgttacgct

SEQ ID NO: 6795 - DNA, 20 bp, Artificial
  20-mer unique DNA sequence
caaccaggtgtcctcaggct

SEQ ID NO: 6796 - DNA, 20 bp, Artificial
  20-mer unique DNA sequence
gcgggaggggtgaaactgag

SEQ ID NO: 6797 - DNA, 20 bp, Artificial
  20-mer unique DNA sequence
tgggggggaaggcgagatgg

SEQ ID NO: 6798 - DNA, 20 bp, Artificial
  20-mer unique DNA sequence
agaagcgaacgagccccaca

SEQ ID NO: 6799 - DNA, 20 bp, Artificial
  20-mer unique DNA sequence
ggagcggcaggggagtttcg

SEQ ID NO: 6800 - DNA, 20 bp, Artificial
  20-mer unique DNA sequence
acttaaagggatgcgggggg

SEQ ID NO: 6801 - DNA, 20 bp, Artificial
  20-mer unique DNA sequence
ggccgcaaatacgggagaga

SEQ ID NO: 6802 - DNA, 20 bp, Artificial
  20-mer unique DNA sequence
aggcatgcgcgagaaaacat

SEQ ID NO: 6803 - DNA, 20 bp, Artificial
  20-mer unique DNA sequence
acctatcatgtggcgtcggg

SEQ ID NO: 6804 - DNA, 20 bp, Artificial
  20-mer unique DNA sequence
tttcggttgcgtgggcttca

SEQ ID NO: 6805 - DNA, 20 bp, Artificial
  20-mer unique DNA sequence
tatttgttgcgtcggggcgg

SEQ ID NO: 6806 - DNA, 20 bp, Artificial
  20-mer unique DNA sequence
ggctaggctttgttggcggc

SEQ ID NO: 6807 - DNA, 20 bp, Artificial
  20-mer unique DNA sequence
ttgctcccgtcccttatgcc

SEQ ID NO: 6808 - DNA, 20 bp, Artificial
  20-mer unique DNA sequence
cgaccccggaaggcctagtg

SEQ ID NO: 6809 - DNA, 20 bp, Artificial
  20-mer unique DNA sequence
gacttccgcgcgcattaccg

SEQ ID NO: 6810 - DNA, 20 bp, Artificial
  20-mer unique DNA sequence
gtccttttgcgggggcttgt

SEQ ID NO: 6811 - DNA, 20 bp, Artificial
  20-mer unique DNA sequence
acctcctccgctcccccgta

SEQ ID NO: 6812 - DNA, 20 bp, Artificial
  20-mer unique DNA sequence
tttaccaggctgcccagagc

SEQ ID NO: 6813 - DNA, 20 bp, Artificial
  20-mer unique DNA sequence
cctctgccgtctcccttgcc

SEQ ID NO: 6814 - DNA, 20 bp, Artificial
  20-mer unique DNA sequence
tgggggtgaggcgggagagt

SEQ ID NO: 6815 - DNA, 20 bp, Artificial
  20-mer unique DNA sequence
tccgcttttctttcgccaca

SEQ ID NO: 6816 - DNA, 20 bp, Artificial
  20-mer unique DNA sequence
cacccatccgcgaagtcaaa

SEQ ID NO: 6817 - DNA, 20 bp, Artificial
  20-mer unique DNA sequence
ggatgggcggagctgagttg

SEQ ID NO: 6818 - DNA, 20 bp, Artificial
  20-mer unique DNA sequence
gcgccaacacctaacgcgag

SEQ ID NO: 6819 - DNA, 20 bp, Artificial
  20-mer unique DNA sequence
cggcgcgtctttggcactaa

SEQ ID NO: 6820 - DNA, 20 bp, Artificial
  20-mer unique DNA sequence
atgttcagagccccaccccg

SEQ ID NO: 6821 - DNA, 20 bp, Artificial
  20-mer unique DNA sequence
gcaagccagatagcaccgcc

SEQ ID NO: 6822 - DNA, 20 bp, Artificial
  20-mer unique DNA sequence
acaaacgcgcggaaaaggaa

SEQ ID NO: 6823 - DNA, 20 bp, Artificial
  20-mer unique DNA sequence
gtggctggcgagaaagctgt

SEQ ID NO: 6824 - DNA, 20 bp, Artificial
  20-mer unique DNA sequence
tcgataggcgcagcacagtc

SEQ ID NO: 6825 - DNA, 20 bp, Artificial
  20-mer unique DNA sequence
tgacacacggtctgacccct

SEQ ID NO: 6826 - DNA, 20 bp, Artificial
  20-mer unique DNA sequence
ttgcaaactgcgtcagggga

SEQ ID NO: 6827 - DNA, 20 bp, Artificial
  20-mer unique DNA sequence
gatcccctcacgaccaagcc

SEQ ID NO: 6828 - DNA, 20 bp, Artificial
  20-mer unique DNA sequence
cagcggtcgagaaggatagg

SEQ ID NO: 6829 - DNA, 20 bp, Artificial
  20-mer unique DNA sequence
acctccatccccgacaccgc

SEQ ID NO: 6830 - DNA, 20 bp, Artificial
  20-mer unique DNA sequence
cggttgacagtcctagcggt

SEQ ID NO: 6831 - DNA, 20 bp, Artificial
  20-mer unique DNA sequence
tggctgtccagggctaaagg

SEQ ID NO: 6832 - DNA, 20 bp, Artificial
  20-mer unique DNA sequence
actgcggtcacgtgcggaaa

SEQ ID NO: 6833 - DNA, 20 bp, Artificial
  20-mer unique DNA sequence
agggagtgcagaaaggggct

SEQ ID NO: 6834 - DNA, 20 bp, Artificial
  20-mer unique DNA sequence
caaaaacggacattccccgc

SEQ ID NO: 6835 - DNA, 20 bp, Artificial
  20-mer unique DNA sequence
cccagcacgaccacgactcg

SEQ ID NO: 6836 - DNA, 20 bp, Artificial
  20-mer unique DNA sequence
tattctcgcaggcccacacg

SEQ ID NO: 6837 - DNA, 20 bp, Artificial
  20-mer unique DNA sequence
cgtcaaacgatccggcgctc

SEQ ID NO: 6838 - DNA, 20 bp, Artificial
  20-mer unique DNA sequence
aggcgacacgggcatagctc

SEQ ID NO: 6839 - DNA, 20 bp, Artificial
  20-mer unique DNA sequence
cggtccatggcgggaaaaga

SEQ ID NO: 6840 - DNA, 20 bp, Artificial
  20-mer unique DNA sequence
gaatgcgcaaacggggagag

SEQ ID NO: 6841 - DNA, 20 bp, Artificial
  20-mer unique DNA sequence
agcgcggtcggggtgaaact

SEQ ID NO: 6842 - DNA, 20 bp, Artificial
  20-mer unique DNA sequence
gtacttggacgccggtgggg

SEQ ID NO: 6843 - DNA, 20 bp, Artificial
  20-mer unique DNA sequence
acatggtgaagcgggggatc

SEQ ID NO: 6844 - DNA, 20 bp, Artificial
  20-mer unique DNA sequence
agtgaaaaaggccgcgatgc

SEQ ID NO: 6845 - DNA, 20 bp, Artificial
  20-mer unique DNA sequence
gaagcaccggccaactccat

SEQ ID NO: 6846 - DNA, 20 bp, Artificial
  20-mer unique DNA sequence
ttcatctcccgcgctgtcgg

SEQ ID NO: 6847 - DNA, 20 bp, Artificial
  20-mer unique DNA sequence
cgcaaatgatgaaaggcggc

SEQ ID NO: 6848 - DNA, 20 bp, Artificial
  20-mer unique DNA sequence
aaacggggggcgctaggtca

SEQ ID NO: 6849 - DNA, 20 bp, Artificial
  20-mer unique DNA sequence
ctagcatgacggagggggcg

SEQ ID NO: 6850 - DNA, 20 bp, Artificial
  20-mer unique DNA sequence
cgcacgggatgaaaacagca

SEQ ID NO: 6851 - DNA, 20 bp, Artificial
  20-mer unique DNA sequence
atgttgttgcccgggcttga

SEQ ID NO: 6852 - DNA, 20 bp, Artificial
  20-mer unique DNA sequence
aagacggtagcgccccagag

SEQ ID NO: 6853 - DNA, 20 bp, Artificial
  20-mer unique DNA sequence
aggcgaaagttaggggcggg

SEQ ID NO: 6854 - DNA, 20 bp, Artificial
  20-mer unique DNA sequence
acggggctcgcatgtacttc

SEQ ID NO: 6855 - DNA, 20 bp, Artificial
  20-mer unique DNA sequence
tatgcggtgcgagcaactcc

SEQ ID NO: 6856 - DNA, 20 bp, Artificial
  20-mer unique DNA sequence
atggcgtagatcggcgtcgt

SEQ ID NO: 6857 - DNA, 20 bp, Artificial
  20-mer unique DNA sequence
aaccgtgtgcggctgtacaa

SEQ ID NO: 6858 - DNA, 20 bp, Artificial
  20-mer unique DNA sequence
taaacagggccgaggatgcg

SEQ ID NO: 6859 - DNA, 20 bp, Artificial
  20-mer unique DNA sequence
gccacagagcccagatccgg

SEQ ID NO: 6860 - DNA, 20 bp, Artificial
  20-mer unique DNA sequence
cccacccccttgctaccgag

SEQ ID NO: 6861 - DNA, 20 bp, Artificial
  20-mer unique DNA sequence
agggttgacttctggccgga

SEQ ID NO: 6862 - DNA, 20 bp, Artificial
  20-mer unique DNA sequence
tgaaccgataccaaccgcga

SEQ ID NO: 6863 - DNA, 20 bp, Artificial
  20-mer unique DNA sequence
agaaacgtatgccacccgcc

SEQ ID NO: 6864 - DNA, 20 bp, Artificial
  20-mer unique DNA sequence
agcgtcgcggcgatcctatt

SEQ ID NO: 6865 - DNA, 20 bp, Artificial
  20-mer unique DNA sequence
cggttaccctagcggacgtt

SEQ ID NO: 6866 - DNA, 20 bp, Artificial
  20-mer unique DNA sequence
aacgtctcgccgtcgcatcc

SEQ ID NO: 6867 - DNA, 20 bp, Artificial
  20-mer unique DNA sequence
cggactgcgccaacaccatt

SEQ ID NO: 6868 - DNA, 20 bp, Artificial
  20-mer unique DNA sequence
aggtaatgcaagggtgccgg

SEQ ID NO: 6869 - DNA, 20 bp, Artificial
  20-mer unique DNA sequence
gcgtgtcggacgggcctttt

SEQ ID NO: 6870 - DNA, 20 bp, Artificial
  20-mer unique DNA sequence
acgtcatgttgggttcggcg

SEQ ID NO: 6871 - DNA, 20 bp, Artificial
  20-mer unique DNA sequence
atgatgaggcggatgggggt

SEQ ID NO: 6872 - DNA, 20 bp, Artificial
  20-mer unique DNA sequence
gaggagacgcggagtgggtg

SEQ ID NO: 6873 - DNA, 20 bp, Artificial
  20-mer unique DNA sequence
ttcaccccatatgcccgctc

SEQ ID NO: 6874 - DNA, 20 bp, Artificial
  20-mer unique DNA sequence
ggttcgtcagccctccgcat

SEQ ID NO: 6875 - DNA, 20 bp, Artificial
  20-mer unique DNA sequence
ttcggttttccccgggtcgt

SEQ ID NO: 6876 - DNA, 20 bp, Artificial
  20-mer unique DNA sequence
gatgagacgggcatagcgca

SEQ ID NO: 6877 - DNA, 20 bp, Artificial
  20-mer unique DNA sequence
agttgctggtcgcgggtttt

SEQ ID NO: 6878 - DNA, 20 bp, Artificial
  20-mer unique DNA sequence
cttgcgtcataggtgggccc

SEQ ID NO: 6879 - DNA, 20 bp, Artificial
  20-mer unique DNA sequence
cttcccggcgcttggttcat

SEQ ID NO: 6880 - DNA, 20 bp, Artificial
  20-mer unique DNA sequence
ggctgctcgtgggtgttgga

SEQ ID NO: 6881 - DNA, 20 bp, Artificial
  20-mer unique DNA sequence
ccccccggcaaagctgaaac

SEQ ID NO: 6882 - DNA, 20 bp, Artificial
  20-mer unique DNA sequence
gaacggaaaacggccaagga

SEQ ID NO: 6883 - DNA, 20 bp, Artificial
  20-mer unique DNA sequence
ggacctaccatcgcccgcac

SEQ ID NO: 6884 - DNA, 20 bp, Artificial
  20-mer unique DNA sequence
gcagtacgagccggcagcat

SEQ ID NO: 6885 - DNA, 20 bp, Artificial
  20-mer unique DNA sequence
tcgtccgccaaaacgtcaca

SEQ ID NO: 6886 - DNA, 20 bp, Artificial
  20-mer unique DNA sequence
agctgcaggggtcggttgaa

SEQ ID NO: 6887 - DNA, 20 bp, Artificial
  20-mer unique DNA sequence
acccaaccctagccatgcga

SEQ ID NO: 6888 - DNA, 20 bp, Artificial
  20-mer unique DNA sequence
tgaggacgggagcggagcat

SEQ ID NO: 6889 - DNA, 20 bp, Artificial
  20-mer unique DNA sequence
tacgtccaagccacatcggg

SEQ ID NO: 6890 - DNA, 20 bp, Artificial
  20-mer unique DNA sequence
atggccgtctaactggcgca

SEQ ID NO: 6891 - DNA, 20 bp, Artificial
  20-mer unique DNA sequence
aggacagtccgaatcgtgcg

SEQ ID NO: 6892 - DNA, 20 bp, Artificial
  20-mer unique DNA sequence
atgacaccaacccgggaacc

SEQ ID NO: 6893 - DNA, 20 bp, Artificial
  20-mer unique DNA sequence
gcgccggttgcaattgttcc

SEQ ID NO: 6894 - DNA, 20 bp, Artificial
  20-mer unique DNA sequence
agcaaactgtggacgccgga

SEQ ID NO: 6895 - DNA, 20 bp, Artificial
  20-mer unique DNA sequence
cgtgtatggagtgcggcagg

SEQ ID NO: 6896 - DNA, 20 bp, Artificial
  20-mer unique DNA sequence
aggagccgctcatgtgtgtg

SEQ ID NO: 6897 - DNA, 20 bp, Artificial
  20-mer unique DNA sequence
cgcagtgaccaggacctgaa

SEQ ID NO: 6898 - DNA, 20 bp, Artificial
  20-mer unique DNA sequence
ccgcctccttttccaccctg

SEQ ID NO: 6899 - DNA, 20 bp, Artificial
  20-mer unique DNA sequence
ccaagccaagcagccactcc

SEQ ID NO: 6900 - DNA, 20 bp, Artificial
  20-mer unique DNA sequence
cagccggtcattccccacag

SEQ ID NO: 6901 - DNA, 20 bp, Artificial
  20-mer unique DNA sequence
cgtattgcctgaggggcggt

SEQ ID NO: 6902 - DNA, 20 bp, Artificial
  20-mer unique DNA sequence
ttcgcgtgcggtgacctctt

SEQ ID NO: 6903 - DNA, 20 bp, Artificial
  20-mer unique DNA sequence
caactaacctcggtcccgct

SEQ ID NO: 6904 - DNA, 20 bp, Artificial
  20-mer unique DNA sequence
atcccctccacgcaaccgat

SEQ ID NO: 6905 - DNA, 20 bp, Artificial
  20-mer unique DNA sequence
ccgcaaaccccgtccaacaa

SEQ ID NO: 6906 - DNA, 20 bp, Artificial
  20-mer unique DNA sequence
gaaccccggaagacccccgt

SEQ ID NO: 6907 - DNA, 20 bp, Artificial
  20-mer unique DNA sequence
gtgagcgaggcggtttgtgg

SEQ ID NO: 6908 - DNA, 20 bp, Artificial
  20-mer unique DNA sequence
cgggcacctggctataccgt

SEQ ID NO: 6909 - DNA, 20 bp, Artificial
  20-mer unique DNA sequence
caatcccgccgaagacatga

SEQ ID NO: 6910 - DNA, 20 bp, Artificial
  20-mer unique DNA sequence
ccacgacccctcacgaacgc

SEQ ID NO: 6911 - DNA, 20 bp, Artificial
  20-mer unique DNA sequence
gcatcgggctctcctttcgg

SEQ ID NO: 6912 - DNA, 20 bp, Artificial
  20-mer unique DNA sequence
tgtgcaaaaggtgacgcggc

SEQ ID NO: 6913 - DNA, 20 bp, Artificial
  20-mer unique DNA sequence
tccaggccgcggttagggag

SEQ ID NO: 6914 - DNA, 20 bp, Artificial
  20-mer unique DNA sequence
aggcgatgcaccaagcaaaa

SEQ ID NO: 6915 - DNA, 20 bp, Artificial
  20-mer unique DNA sequence
cggagccgtcaggaagcatt

SEQ ID NO: 6916 - DNA, 20 bp, Artificial
  20-mer unique DNA sequence
taaaccctcttgcccccgcg

SEQ ID NO: 6917 - DNA, 20 bp, Artificial
  20-mer unique DNA sequence
gagcaccaccaaagcaccgg

SEQ ID NO: 6918 - DNA, 20 bp, Artificial
  20-mer unique DNA sequence
ctcaactaccccaagcgccg

SEQ ID NO: 6919 - DNA, 20 bp, Artificial
  20-mer unique DNA sequence
tatgctctcgcctttgcccg

SEQ ID NO: 6920 - DNA, 20 bp, Artificial
  20-mer unique DNA sequence
gtcgctcttcaccctcgccg

SEQ ID NO: 6921 - DNA, 20 bp, Artificial
  20-mer unique DNA sequence
gccgcggggttctgagttcc

SEQ ID NO: 6922 - DNA, 20 bp, Artificial
  20-mer unique DNA sequence
gtctcccatcgcgctccact

SEQ ID NO: 6923 - DNA, 20 bp, Artificial
  20-mer unique DNA sequence
gccggatatgtggggggaag

SEQ ID NO: 6924 - DNA, 20 bp, Artificial
  20-mer unique DNA sequence
gggcgcggagggttaggact

SEQ ID NO: 6925 - DNA, 20 bp, Artificial
  20-mer unique DNA sequence
cgtgactgaagaggcggtgg

SEQ ID NO: 6926 - DNA, 20 bp, Artificial
  20-mer unique DNA sequence
tgctccgcgcctgtaactgt

SEQ ID NO: 6927 - DNA, 20 bp, Artificial
  20-mer unique DNA sequence
ggaaactcggggaaaggcgt

SEQ ID NO: 6928 - DNA, 20 bp, Artificial
  20-mer unique DNA sequence
gagcccgggacacatcgaaa

SEQ ID NO: 6929 - DNA, 20 bp, Artificial
  20-mer unique DNA sequence
cataaggccatgggggggga

SEQ ID NO: 6930 - DNA, 20 bp, Artificial
  20-mer unique DNA sequence
gtgcccctgctcaaacccgt

SEQ ID NO: 6931 - DNA, 20 bp, Artificial
  20-mer unique DNA sequence
catcgcccgttttcatccca

SEQ ID NO: 6932 - DNA, 20 bp, Artificial
  20-mer unique DNA sequence
cccgcaacggactcacaagg

SEQ ID NO: 6933 - DNA, 20 bp, Artificial
  20-mer unique DNA sequence
gtgatctcgagtggcgtctg

SEQ ID NO: 6934 - DNA, 20 bp, Artificial
  20-mer unique DNA sequence
cgatgtgcgtcacctgaacc

SEQ ID NO: 6935 - DNA, 20 bp, Artificial
  20-mer unique DNA sequence
tctcggatcagaggcccagt

SEQ ID NO: 6936 - DNA, 20 bp, Artificial
  20-mer unique DNA sequence
acaccccgcttgcccagaaa

SEQ ID NO: 6937 - DNA, 20 bp, Artificial
  20-mer unique DNA sequence
ggacctccgcccttcttcga

SEQ ID NO: 6938 - DNA, 20 bp, Artificial
  20-mer unique DNA sequence
aaaccggtcgacttgctcca

SEQ ID NO: 6939 - DNA, 20 bp, Artificial
  20-mer unique DNA sequence
tgcagggagtggtgacgggt

SEQ ID NO: 6940 - DNA, 20 bp, Artificial
  20-mer unique DNA sequence
ctgagaaggggagtgcgggt

SEQ ID NO: 6941 - DNA, 20 bp, Artificial
  20-mer unique DNA sequence
acaagcgccgaacagccaca

SEQ ID NO: 6942 - DNA, 20 bp, Artificial
  20-mer unique DNA sequence
ttttacgaaccggctcgggg

SEQ ID NO: 6943 - DNA, 20 bp, Artificial
  20-mer unique DNA sequence
acgtcttacccggcgcacaa

SEQ ID NO: 6944 - DNA, 20 bp, Artificial
  20-mer unique DNA sequence
tgggctcggcacgtatccgg

SEQ ID NO: 6945 - DNA, 20 bp, Artificial
  20-mer unique DNA sequence
cctaggtgtttcggggtcgc

SEQ ID NO: 6946 - DNA, 20 bp, Artificial
  20-mer unique DNA sequence
cgccgccagaaaccgattac

SEQ ID NO: 6947 - DNA, 20 bp, Artificial
  20-mer unique DNA sequence
cccttcagacccagccaacc

SEQ ID NO: 6948 - DNA, 20 bp, Artificial
  20-mer unique DNA sequence
ggtccaaagggccagatgcg

SEQ ID NO: 6949 - DNA, 20 bp, Artificial
  20-mer unique DNA sequence
ttgcgagcactaccgggcta

SEQ ID NO: 6950 - DNA, 20 bp, Artificial
  20-mer unique DNA sequence
ttacatggtgcgcgtcgggt

SEQ ID NO: 6951 - DNA, 20 bp, Artificial
  20-mer unique DNA sequence
ctcggccttcgctctccctc

SEQ ID NO: 6952 - DNA, 20 bp, Artificial
  20-mer unique DNA sequence
ccggggtttaggatcgaggc

SEQ ID NO: 6953 - DNA, 20 bp, Artificial
  20-mer unique DNA sequence
ccccatgatgtttacgcggc

SEQ ID NO: 6954 - DNA, 20 bp, Artificial
  20-mer unique DNA sequence
tgggagactttggctggcgt

SEQ ID NO: 6955 - DNA, 20 bp, Artificial
  20-mer unique DNA sequence
tgtccgccccgtccttctga

SEQ ID NO: 6956 - DNA, 20 bp, Artificial
  20-mer unique DNA sequence
cagcgtcgaccgggaaaaac

SEQ ID NO: 6957 - DNA, 20 bp, Artificial
  20-mer unique DNA sequence
gcggtggggtggcgaatacg

SEQ ID NO: 6958 - DNA, 20 bp, Artificial
  20-mer unique DNA sequence
cctccagacaatcgccctcc

SEQ ID NO: 6959 - DNA, 20 bp, Artificial
  20-mer unique DNA sequence
accagaccttgacccgctcg

SEQ ID NO: 6960 - DNA, 20 bp, Artificial
  20-mer unique DNA sequence
cccgatgcggcttgttcctg

SEQ ID NO: 6961 - DNA, 20 bp, Artificial
  20-mer unique DNA sequence
atccttttggcgcgcgtgta

SEQ ID NO: 6962 - DNA, 20 bp, Artificial
  20-mer unique DNA sequence
tgctcgtaccttgcccctgg

SEQ ID NO: 6963 - DNA, 20 bp, Artificial
  20-mer unique DNA sequence
ccggggaaatcgcagtgtct

SEQ ID NO: 6964 - DNA, 20 bp, Artificial
  20-mer unique DNA sequence
aaccgccccaagaaatccga

SEQ ID NO: 6965 - DNA, 20 bp, Artificial
  20-mer unique DNA sequence
gtcaaacttaaatcgccgcc

SEQ ID NO: 6966 - DNA, 20 bp, Artificial
  20-mer unique DNA sequence
caccattttctcggcgtccc

SEQ ID NO: 6967 - DNA, 20 bp, Artificial
  20-mer unique DNA sequence
tttgtcgggggctgttgcac

SEQ ID NO: 6968 - DNA, 20 bp, Artificial
  20-mer unique DNA sequence
ttcgggtgtggtcgggtgtg

SEQ ID NO: 6969 - DNA, 20 bp, Artificial
  20-mer unique DNA sequence
gctcgcctctccggttgcct

SEQ ID NO: 6970 - DNA, 20 bp, Artificial
  20-mer unique DNA sequence
ccccagaacccagccacaca

SEQ ID NO: 6971 - DNA, 20 bp, Artificial
  20-mer unique DNA sequence
ggaggggggcggtcttttgt

SEQ ID NO: 6972 - DNA, 20 bp, Artificial
  20-mer unique DNA sequence
gccactgccccaattgtcaa

SEQ ID NO: 6973 - DNA, 20 bp, Artificial
  20-mer unique DNA sequence
gcgcccccctcgtatctagc

SEQ ID NO: 6974 - DNA, 20 bp, Artificial
  20-mer unique DNA sequence
tattgtaagcggcacgggcg

SEQ ID NO: 6975 - DNA, 20 bp, Artificial
  20-mer unique DNA sequence
caagttgcaagaggcagcgc

SEQ ID NO: 6976 - DNA, 20 bp, Artificial
  20-mer unique DNA sequence
aagtgagggtaccgagggaa

SEQ ID NO: 6977 - DNA, 20 bp, Artificial
  20-mer unique DNA sequence
ttcccactcaaaccccgcct

SEQ ID NO: 6978 - DNA, 20 bp, Artificial
  20-mer unique DNA sequence
ggcccgcaccatcgtcatta

SEQ ID NO: 6979 - DNA, 20 bp, Artificial
  20-mer unique DNA sequence
tggcgttaacctagtcgccc

SEQ ID NO: 6980 - DNA, 20 bp, Artificial
  20-mer unique DNA sequence
tgggagcagcaacgggagac

SEQ ID NO: 6981 - DNA, 20 bp, Artificial
  20-mer unique DNA sequence
tgcctgccaacacctgctca

SEQ ID NO: 6982 - DNA, 20 bp, Artificial
  20-mer unique DNA sequence
ggtaattccccgcgagcctt

SEQ ID NO: 6983 - DNA, 20 bp, Artificial
  20-mer unique DNA sequence
ggcggcgcatcgaatttaat

SEQ ID NO: 6984 - DNA, 20 bp, Artificial
  20-mer unique DNA sequence
cccctcgccaagcaaagcaa

SEQ ID NO: 6985 - DNA, 20 bp, Artificial
  20-mer unique DNA sequence
tgtggcaacgtgatggagct

SEQ ID NO: 6986 - DNA, 20 bp, Artificial
  20-mer unique DNA sequence
ccaacaaaagggaggttggg

SEQ ID NO: 6987 - DNA, 20 bp, Artificial
  20-mer unique DNA sequence
gccttcgtcgccccgattaa

SEQ ID NO: 6988 - DNA, 20 bp, Artificial
  20-mer unique DNA sequence
ccaccgctttttcaccccga

SEQ ID NO: 6989 - DNA, 20 bp, Artificial
  20-mer unique DNA sequence
gccaaggggcggctaagtgt

SEQ ID NO: 6990 - DNA, 20 bp, Artificial
  20-mer unique DNA sequence
ttccccacccccgccctatt

SEQ ID NO: 6991 - DNA, 20 bp, Artificial
  20-mer unique DNA sequence
cacgggaaagcatgcgacca

SEQ ID NO: 6992 - DNA, 20 bp, Artificial
  20-mer unique DNA sequence
ccgcgataccaggagcatga

SEQ ID NO: 6993 - DNA, 20 bp, Artificial
  20-mer unique DNA sequence
cgcttccaggtcgttgcatc

SEQ ID NO: 6994 - DNA, 20 bp, Artificial
  20-mer unique DNA sequence
aacgcccggcccgtattaaa

SEQ ID NO: 6995 - DNA, 20 bp, Artificial
  20-mer unique DNA sequence
acgcgggaccggttcgaata

SEQ ID NO: 6996 - DNA, 20 bp, Artificial
  20-mer unique DNA sequence
gttcttggatggagcggcga

SEQ ID NO: 6997 - DNA, 20 bp, Artificial
  20-mer unique DNA sequence
ggctgcggtgctgtggtaga

SEQ ID NO: 6998 - DNA, 20 bp, Artificial
  20-mer unique DNA sequence
cggggggtcgactagctgaa

SEQ ID NO: 6999 - DNA, 20 bp, Artificial
  20-mer unique DNA sequence
tgcccccctcttacataccc

SEQ ID NO: 7000 - DNA, 20 bp, Artificial
  20-mer unique DNA sequence
cagcggtatcacgtcggact

SEQ ID NO: 7001 - DNA, 20 bp, Artificial
  20-mer unique DNA sequence
aacagtggctcagctctccc

SEQ ID NO: 7002 - DNA, 20 bp, Artificial
  20-mer unique DNA sequence
cccacggatccgggcaaacc

SEQ ID NO: 7003 - DNA, 20 bp, Artificial
  20-mer unique DNA sequence
gcccgcttttccttacgcca

SEQ ID NO: 7004 - DNA, 20 bp, Artificial
  20-mer unique DNA sequence
ccgagggtgcattggagcgt

SEQ ID NO: 7005 - DNA, 20 bp, Artificial
  20-mer unique DNA sequence
tgtacgatctgtgcggccgg

SEQ ID NO: 7006 - DNA, 20 bp, Artificial
  20-mer unique DNA sequence
ggtcccgcttcgagttcccc

SEQ ID NO: 7007 - DNA, 20 bp, Artificial
  20-mer unique DNA sequence
tagcaaacagcagacggccg

SEQ ID NO: 7008 - DNA, 20 bp, Artificial
  20-mer unique DNA sequence
aaaaggtctatccggggtcg

SEQ ID NO: 7009 - DNA, 20 bp, Artificial
  20-mer unique DNA sequence
gcgcgttgttacgattggga

SEQ ID NO: 7010 - DNA, 20 bp, Artificial
  20-mer unique DNA sequence
cgccgggaaaaaaatgtgag

SEQ ID NO: 7011 - DNA, 20 bp, Artificial
  20-mer unique DNA sequence
ttggcaacctacgtcccgct

SEQ ID NO: 7012 - DNA, 20 bp, Artificial
  20-mer unique DNA sequence
tgaacgcagacggacccagg

SEQ ID NO: 7013 - DNA, 20 bp, Artificial
  20-mer unique DNA sequence
gggggccaataactcgtcca

SEQ ID NO: 7014 - DNA, 20 bp, Artificial
  20-mer unique DNA sequence
ggtgtgatggggtcgggagc

SEQ ID NO: 7015 - DNA, 20 bp, Artificial
  20-mer unique DNA sequence
cagttccgccaccaagccgt

SEQ ID NO: 7016 - DNA, 20 bp, Artificial
  20-mer unique DNA sequence
ctgagttccgacaacccgca

SEQ ID NO: 7017 - DNA, 20 bp, Artificial
  20-mer unique DNA sequence
gtactgctcggctggccctt

SEQ ID NO: 7018 - DNA, 20 bp, Artificial
  20-mer unique DNA sequence
cccggttcgcatatggttcg

SEQ ID NO: 7019 - DNA, 20 bp, Artificial
  20-mer unique DNA sequence
ctcgcacccgacaccaaacc

SEQ ID NO: 7020 - DNA, 20 bp, Artificial
  20-mer unique DNA sequence
tcgcatggcggtgagttgac

SEQ ID NO: 7021 - DNA, 20 bp, Artificial
  20-mer unique DNA sequence
tcccccacccttgagcaaaa

SEQ ID NO: 7022 - DNA, 20 bp, Artificial
  20-mer unique DNA sequence
actcgttcgggctggctgga

SEQ ID NO: 7023 - DNA, 20 bp, Artificial
  20-mer unique DNA sequence
ctgctctgccctcgaatgcc

SEQ ID NO: 7024 - DNA, 20 bp, Artificial
  20-mer unique DNA sequence
acgcggagaccgtgtacttt

SEQ ID NO: 7025 - DNA, 20 bp, Artificial
  20-mer unique DNA sequence
tcgtctcagaggtccaacgc

SEQ ID NO: 7026 - DNA, 20 bp, Artificial
  20-mer unique DNA sequence
cgcccagtaaacccagccca

SEQ ID NO: 7027 - DNA, 20 bp, Artificial
  20-mer unique DNA sequence
agcccacccttcacccgatt

SEQ ID NO: 7028 - DNA, 20 bp, Artificial
  20-mer unique DNA sequence
agtggagaggcaccaagcgc

SEQ ID NO: 7029 - DNA, 20 bp, Artificial
  20-mer unique DNA sequence
atgtgcggtgtggcgttccc

SEQ ID NO: 7030 - DNA, 20 bp, Artificial
  20-mer unique DNA sequence
agcgacaacgacccaaccct

SEQ ID NO: 7031 - DNA, 20 bp, Artificial
  20-mer unique DNA sequence
gatgggcgtattgcagagcg

SEQ ID NO: 7032 - DNA, 20 bp, Artificial
  20-mer unique DNA sequence
agccgcccaatttctcccga

SEQ ID NO: 7033 - DNA, 20 bp, Artificial
  20-mer unique DNA sequence
ggcgtccctgcgttcgttat

SEQ ID NO: 7034 - DNA, 20 bp, Artificial
  20-mer unique DNA sequence
tggtatcgcgggcaggtttg

SEQ ID NO: 7035 - DNA, 20 bp, Artificial
  20-mer unique DNA sequence
tttgcccggtgtgttcgttg

SEQ ID NO: 7036 - DNA, 20 bp, Artificial
  20-mer unique DNA sequence
caccgttaccagcgcccagg

SEQ ID NO: 7037 - DNA, 20 bp, Artificial
  20-mer unique DNA sequence
cacgtcgggcacatatgcgc

SEQ ID NO: 7038 - DNA, 20 bp, Artificial
  20-mer unique DNA sequence
cccctgaattgagctccgcc

SEQ ID NO: 7039 - DNA, 20 bp, Artificial
  20-mer unique DNA sequence
accccccgcgactagacttg

SEQ ID NO: 7040 - DNA, 20 bp, Artificial
  20-mer unique DNA sequence
cgtcaccgagaccctagccg

SEQ ID NO: 7041 - DNA, 20 bp, Artificial
  20-mer unique DNA sequence
gcgcaattccacctcagcag

SEQ ID NO: 7042 - DNA, 20 bp, Artificial
  20-mer unique DNA sequence
taaaaccaatgccgcggacc

SEQ ID NO: 7043 - DNA, 20 bp, Artificial
  20-mer unique DNA sequence
gacccccggcacgtattcct

SEQ ID NO: 7044 - DNA, 20 bp, Artificial
  20-mer unique DNA sequence
taggcggactcgggcagaat

SEQ ID NO: 7045 - DNA, 20 bp, Artificial
  20-mer unique DNA sequence
ttcgcgcctccaccctcagt

SEQ ID NO: 7046 - DNA, 20 bp, Artificial
  20-mer unique DNA sequence
gcacggtgatgcgtcgatga

SEQ ID NO: 7047 - DNA, 20 bp, Artificial
  20-mer unique DNA sequence
tcatccgtcggagcagagca

SEQ ID NO: 7048 - DNA, 20 bp, Artificial
  20-mer unique DNA sequence
tccctggctcttctgcgacg

SEQ ID NO: 7049 - DNA, 20 bp, Artificial
  20-mer unique DNA sequence
ggacctgccgcgctttacat

SEQ ID NO: 7050 - DNA, 20 bp, Artificial
  20-mer unique DNA sequence
tgtgctcttgcgtcccgatt

SEQ ID NO: 7051 - DNA, 20 bp, Artificial
  20-mer unique DNA sequence
gcgggcttctcttgctgggt

SEQ ID NO: 7052 - DNA, 20 bp, Artificial
  20-mer unique DNA sequence
accaccagacacgctccgct

SEQ ID NO: 7053 - DNA, 20 bp, Artificial
  20-mer unique DNA sequence
gggcgggtggctaaaatcgg

SEQ ID NO: 7054 - DNA, 20 bp, Artificial
  20-mer unique DNA sequence
gcggggggataggtgtaggc

SEQ ID NO: 7055 - DNA, 20 bp, Artificial
  20-mer unique DNA sequence
gtgtcggtcttcgggagggc

SEQ ID NO: 7056 - DNA, 20 bp, Artificial
  20-mer unique DNA sequence
attcggtcgtgggggtcctc

SEQ ID NO: 7057 - DNA, 20 bp, Artificial
  20-mer unique DNA sequence
ccgctgccccttttatttcg

SEQ ID NO: 7058 - DNA, 20 bp, Artificial
  20-mer unique DNA sequence
gcaacggaaataccccgcat

SEQ ID NO: 7059 - DNA, 20 bp, Artificial
  20-mer unique DNA sequence
gaatagcggcgttggccaaa

SEQ ID NO: 7060 - DNA, 20 bp, Artificial
  20-mer unique DNA sequence
ctgcgaggggggaactttga

SEQ ID NO: 7061 - DNA, 20 bp, Artificial
  20-mer unique DNA sequence
atgagccaccgttcgcgaga

SEQ ID NO: 7062 - DNA, 20 bp, Artificial
  20-mer unique DNA sequence
gcccagcacagcgtaaaccg

SEQ ID NO: 7063 - DNA, 20 bp, Artificial
  20-mer unique DNA sequence
cacccgcaccaccatcagtc

SEQ ID NO: 7064 - DNA, 20 bp, Artificial
  20-mer unique DNA sequence
aagttggatgggggtcggcc

SEQ ID NO: 7065 - DNA, 20 bp, Artificial
  20-mer unique DNA sequence
cgttttctctgccaatgccg

SEQ ID NO: 7066 - DNA, 20 bp, Artificial
  20-mer unique DNA sequence
cggttgcccactttcgtccc

SEQ ID NO: 7067 - DNA, 20 bp, Artificial
  20-mer unique DNA sequence
ctcctcctgatgcccaaccg

SEQ ID NO: 7068 - DNA, 20 bp, Artificial
  20-mer unique DNA sequence
tgggaagggggctaggggag

SEQ ID NO: 7069 - DNA, 20 bp, Artificial
  20-mer unique DNA sequence
acccgcacttgacccattcc

SEQ ID NO: 7070 - DNA, 20 bp, Artificial
  20-mer unique DNA sequence
gaagaaaccccacccatcgg

SEQ ID NO: 7071 - DNA, 20 bp, Artificial
  20-mer unique DNA sequence
ggaagggtttttttggcgcg

SEQ ID NO: 7072 - DNA, 20 bp, Artificial
  20-mer unique DNA sequence
cccaatgaaccgtaaccacc

SEQ ID NO: 7073 - DNA, 20 bp, Artificial
  20-mer unique DNA sequence
acttgtaacctccccgccga

SEQ ID NO: 7074 - DNA, 20 bp, Artificial
  20-mer unique DNA sequence
tcaccttagtgcgaccgggc

SEQ ID NO: 7075 - DNA, 20 bp, Artificial
  20-mer unique DNA sequence
gcctgttgggcttcgcgtat

SEQ ID NO: 7076 - DNA, 20 bp, Artificial
  20-mer unique DNA sequence
cgggaggaagggtgccaata

SEQ ID NO: 7077 - DNA, 20 bp, Artificial
  20-mer unique DNA sequence
tcttcggcgcgtgtttctcg

SEQ ID NO: 7078 - DNA, 20 bp, Artificial
  20-mer unique DNA sequence
ccccacgatcatttccgcct

SEQ ID NO: 7079 - DNA, 20 bp, Artificial
  20-mer unique DNA sequence
gccggcacaacgaatggaga

SEQ ID NO: 7080 - DNA, 20 bp, Artificial
  20-mer unique DNA sequence
gccctaataacgcccagccg

SEQ ID NO: 7081 - DNA, 20 bp, Artificial
  20-mer unique DNA sequence
cggcgtgcaattcgtcaaag

SEQ ID NO: 7082 - DNA, 20 bp, Artificial
  20-mer unique DNA sequence
gatttgctaacgagggcggg

SEQ ID NO: 7083 - DNA, 20 bp, Artificial
  20-mer unique DNA sequence
gcgttgcccctctcctgctg

SEQ ID NO: 7084 - DNA, 20 bp, Artificial
  20-mer unique DNA sequence
gcgggcgggtactgtaatgg

SEQ ID NO: 7085 - DNA, 20 bp, Artificial
  20-mer unique DNA sequence
cagggttccacgttccgcat

SEQ ID NO: 7086 - DNA, 20 bp, Artificial
  20-mer unique DNA sequence
aggcatcaggttcggggagg

SEQ ID NO: 7087 - DNA, 20 bp, Artificial
  20-mer unique DNA sequence
aagattaccacagccgcgcc

SEQ ID NO: 7088 - DNA, 20 bp, Artificial
  20-mer unique DNA sequence
ggcgggggtaaactcagctg

SEQ ID NO: 7089 - DNA, 20 bp, Artificial
  20-mer unique DNA sequence
cgcccaaatcactcccgctg

SEQ ID NO: 7090 - DNA, 20 bp, Artificial
  20-mer unique DNA sequence
gtccgcctagcacacaccga

SEQ ID NO: 7091 - DNA, 20 bp, Artificial
  20-mer unique DNA sequence
tcgccttccatgggcttagc

SEQ ID NO: 7092 - DNA, 20 bp, Artificial
  20-mer unique DNA sequence
agatccactgcccccccacc

SEQ ID NO: 7093 - DNA, 20 bp, Artificial
  20-mer unique DNA sequence
tgggtccttgggcgctagtg

SEQ ID NO: 7094 - DNA, 20 bp, Artificial
  20-mer unique DNA sequence
gaagggccgatgttgcgaac

SEQ ID NO: 7095 - DNA, 20 bp, Artificial
  20-mer unique DNA sequence
agcgccgacagcccagacaa

SEQ ID NO: 7096 - DNA, 20 bp, Artificial
  20-mer unique DNA sequence
gatttggcgatgggtcggtc

SEQ ID NO: 7097 - DNA, 20 bp, Artificial
  20-mer unique DNA sequence
cgcattttgctcgttccacg

SEQ ID NO: 7098 - DNA, 20 bp, Artificial
  20-mer unique DNA sequence
tgctaatgctttgctcgcgg

SEQ ID NO: 7099 - DNA, 20 bp, Artificial
  20-mer unique DNA sequence
aattcgcaaacccgcgcgat

SEQ ID NO: 7100 - DNA, 20 bp, Artificial
  20-mer unique DNA sequence
cgttattttcgtgtgcgcgg

SEQ ID NO: 7101 - DNA, 20 bp, Artificial
  20-mer unique DNA sequence
cggcagacggtgaagacaga

SEQ ID NO: 7102 - DNA, 20 bp, Artificial
  20-mer unique DNA sequence
gcgtatcacggggcagtagt

SEQ ID NO: 7103 - DNA, 20 bp, Artificial
  20-mer unique DNA sequence
ccttaggcgcgacttcgcta

SEQ ID NO: 7104 - DNA, 20 bp, Artificial
  20-mer unique DNA sequence
tcatggggggcgctagtttt

SEQ ID NO: 7105 - DNA, 20 bp, Artificial
  20-mer unique DNA sequence
gccggggacaaaaatgacgc

SEQ ID NO: 7106 - DNA, 20 bp, Artificial
  20-mer unique DNA sequence
ggcttacgcggggcattcgg

SEQ ID NO: 7107 - DNA, 20 bp, Artificial
  20-mer unique DNA sequence
cggtgaagattgcgcagtgg

SEQ ID NO: 7108 - DNA, 20 bp, Artificial
  20-mer unique DNA sequence
tcactccccgccattgtccc

SEQ ID NO: 7109 - DNA, 20 bp, Artificial
  20-mer unique DNA sequence
tgatcccctccctccgcact

SEQ ID NO: 7110 - DNA, 20 bp, Artificial
  20-mer unique DNA sequence
gggatgcgggcgagacagaa

SEQ ID NO: 7111 - DNA, 20 bp, Artificial
  20-mer unique DNA sequence
cagtacccgctcccgccaaa

SEQ ID NO: 7112 - DNA, 20 bp, Artificial
  20-mer unique DNA sequence
ttttttggggacggttcggg

SEQ ID NO: 7113 - DNA, 20 bp, Artificial
  20-mer unique DNA sequence
agggagccgtaaccgatggg

SEQ ID NO: 7114 - DNA, 20 bp, Artificial
  20-mer unique DNA sequence
tcaaccggatggactggggc

SEQ ID NO: 7115 - DNA, 20 bp, Artificial
  20-mer unique DNA sequence
gcggcccatcgaattctcca

SEQ ID NO: 7116 - DNA, 20 bp, Artificial
  20-mer unique DNA sequence
cgcgcgacataggaacagca

SEQ ID NO: 7117 - DNA, 20 bp, Artificial
  20-mer unique DNA sequence
gagccctgttcattccccgc

SEQ ID NO: 7118 - DNA, 20 bp, Artificial
  20-mer unique DNA sequence
ggccggctacgaggttttcc

SEQ ID NO: 7119 - DNA, 20 bp, Artificial
  20-mer unique DNA sequence
cactttccgcgttccttggg

SEQ ID NO: 7120 - DNA, 20 bp, Artificial
  20-mer unique DNA sequence
ggtcaggcctcgggttcatc

SEQ ID NO: 7121 - DNA, 20 bp, Artificial
  20-mer unique DNA sequence
agcgcatcctccgaaccact

SEQ ID NO: 7122 - DNA, 20 bp, Artificial
  20-mer unique DNA sequence
tttgcggttgtcgagatgcg

SEQ ID NO: 7123 - DNA, 20 bp, Artificial
  20-mer unique DNA sequence
ctttctgaggcgcgccctgt

SEQ ID NO: 7124 - DNA, 20 bp, Artificial
  20-mer unique DNA sequence
cgcgctttccagttaccccg

SEQ ID NO: 7125 - DNA, 20 bp, Artificial
  20-mer unique DNA sequence
ctgggccgcgctcctagcct

SEQ ID NO: 7126 - DNA, 20 bp, Artificial
  20-mer unique DNA sequence
ccccctatccggagcaccag

SEQ ID NO: 7127 - DNA, 20 bp, Artificial
  20-mer unique DNA sequence
acgccgcaccacatcacaaa

SEQ ID NO: 7128 - DNA, 20 bp, Artificial
  20-mer unique DNA sequence
tgcagaatgggcgagaccga

SEQ ID NO: 7129 - DNA, 20 bp, Artificial
  20-mer unique DNA sequence
cccacgccactcactcagca

SEQ ID NO: 7130 - DNA, 20 bp, Artificial
  20-mer unique DNA sequence
accaccgccctttcattgct

SEQ ID NO: 7131 - DNA, 20 bp, Artificial
  20-mer unique DNA sequence
tggaggcgtggtgggaatgt

SEQ ID NO: 7132 - DNA, 20 bp, Artificial
  20-mer unique DNA sequence
agcggacgagcaggcgagac

SEQ ID NO: 7133 - DNA, 20 bp, Artificial
  20-mer unique DNA sequence
gcgtgtagaggcttgtgggg

SEQ ID NO: 7134 - DNA, 20 bp, Artificial
  20-mer unique DNA sequence
gggtctcggttgtgctgctg

SEQ ID NO: 7135 - DNA, 20 bp, Artificial
  20-mer unique DNA sequence
ggcaatagggacggatggca

SEQ ID NO: 7136 - DNA, 20 bp, Artificial
  20-mer unique DNA sequence
cggggaaccaaatacggcgg

SEQ ID NO: 7137 - DNA, 20 bp, Artificial
  20-mer unique DNA sequence
gccagtcacgaatcgactgc

SEQ ID NO: 7138 - DNA, 20 bp, Artificial
  20-mer unique DNA sequence
acttattttgccgggggatg

SEQ ID NO: 7139 - DNA, 20 bp, Artificial
  20-mer unique DNA sequence
gaaaaagccccgcccaccac

SEQ ID NO: 7140 - DNA, 20 bp, Artificial
  20-mer unique DNA sequence
cgtaagattgtgtccgcgcg

SEQ ID NO: 7141 - DNA, 20 bp, Artificial
  20-mer unique DNA sequence
gagacggagatgtggcgcga

SEQ ID NO: 7142 - DNA, 20 bp, Artificial
  20-mer unique DNA sequence
gccccgaccatccagagaca

SEQ ID NO: 7143 - DNA, 20 bp, Artificial
  20-mer unique DNA sequence
cggatggtgcgaattgatgg

SEQ ID NO: 7144 - DNA, 20 bp, Artificial
  20-mer unique DNA sequence
ctatttcatggggagcgccg

SEQ ID NO: 7145 - DNA, 20 bp, Artificial
  20-mer unique DNA sequence
gtttcgtgcccggtgtatca

SEQ ID NO: 7146 - DNA, 20 bp, Artificial
  20-mer unique DNA sequence
cccccggcaaccaacctatg

SEQ ID NO: 7147 - DNA, 20 bp, Artificial
  20-mer unique DNA sequence
gcacggaatcatggaggcaa

SEQ ID NO: 7148 - DNA, 20 bp, Artificial
  20-mer unique DNA sequence
atgaaaggcagcgccaacgt

SEQ ID NO: 7149 - DNA, 20 bp, Artificial
  20-mer unique DNA sequence
accttccaatgacccggccg

SEQ ID NO: 7150 - DNA, 20 bp, Artificial
  20-mer unique DNA sequence
gccgtttgggtctggtggtg

SEQ ID NO: 7151 - DNA, 20 bp, Artificial
  20-mer unique DNA sequence
gaccgcgcagcccctataac

SEQ ID NO: 7152 - DNA, 20 bp, Artificial
  20-mer unique DNA sequence
gaaagcccagcgaccaacca

SEQ ID NO: 7153 - DNA, 20 bp, Artificial
  20-mer unique DNA sequence
tcgccaccatcgtaaacggc

SEQ ID NO: 7154 - DNA, 20 bp, Artificial
  20-mer unique DNA sequence
tggggtgctacggcaggaac

SEQ ID NO: 7155 - DNA, 20 bp, Artificial
  20-mer unique DNA sequence
tagctacgtcgggggcggtc

SEQ ID NO: 7156 - DNA, 20 bp, Artificial
  20-mer unique DNA sequence
atcggtagacggggctcaga

SEQ ID NO: 7157 - DNA, 20 bp, Artificial
  20-mer unique DNA sequence
ccgacgccgggtaggatgag

SEQ ID NO: 7158 - DNA, 20 bp, Artificial
  20-mer unique DNA sequence
tagattgggtaccgcggcct

SEQ ID NO: 7159 - DNA, 20 bp, Artificial
  20-mer unique DNA sequence
tggcggaaaagggggttgga

SEQ ID NO: 7160 - DNA, 20 bp, Artificial
  20-mer unique DNA sequence
cggcgggcaccagagatttt

SEQ ID NO: 7161 - DNA, 20 bp, Artificial
  20-mer unique DNA sequence
cccattcgggcccactctag

SEQ ID NO: 7162 - DNA, 20 bp, Artificial
  20-mer unique DNA sequence
gtgtgggcctgcctttgatg

SEQ ID NO: 7163 - DNA, 20 bp, Artificial
  20-mer unique DNA sequence
atctcgccccgcttttgcac

SEQ ID NO: 7164 - DNA, 20 bp, Artificial
  20-mer unique DNA sequence
cccgactctgcaacgctcaa

SEQ ID NO: 7165 - DNA, 20 bp, Artificial
  20-mer unique DNA sequence
aaggcgcccacctgctgaat

SEQ ID NO: 7166 - DNA, 20 bp, Artificial
  20-mer unique DNA sequence
ggcaatacccacccctcacg

SEQ ID NO: 7167 - DNA, 20 bp, Artificial
  20-mer unique DNA sequence
ttccacacaaccgtcccagc

SEQ ID NO: 7168 - DNA, 20 bp, Artificial
  20-mer unique DNA sequence
aaggggaggcaggaaacggt

SEQ ID NO: 7169 - DNA, 20 bp, Artificial
  20-mer unique DNA sequence
cgcgcctgtggtgatgaaat

SEQ ID NO: 7170 - DNA, 20 bp, Artificial
  20-mer unique DNA sequence
tgctgtggcggctgataagg

SEQ ID NO: 7171 - DNA, 20 bp, Artificial
  20-mer unique DNA sequence
gtgctcccgttaagatgcga

SEQ ID NO: 7172 - DNA, 20 bp, Artificial
  20-mer unique DNA sequence
gctgtgctggatccggggta

SEQ ID NO: 7173 - DNA, 20 bp, Artificial
  20-mer unique DNA sequence
cccagcatactcccggtccc

SEQ ID NO: 7174 - DNA, 20 bp, Artificial
  20-mer unique DNA sequence
tccgaaccacacgtagccga

SEQ ID NO: 7175 - DNA, 20 bp, Artificial
  20-mer unique DNA sequence
aagcacgggatggcgagaca

SEQ ID NO: 7176 - DNA, 20 bp, Artificial
  20-mer unique DNA sequence
aacggcctgaggcgtagttc

SEQ ID NO: 7177 - DNA, 20 bp, Artificial
  20-mer unique DNA sequence
aagatcgtcgggaccgggtt

SEQ ID NO: 7178 - DNA, 20 bp, Artificial
  20-mer unique DNA sequence
ctcccctacaagtccgcccc

SEQ ID NO: 7179 - DNA, 20 bp, Artificial
  20-mer unique DNA sequence
ggaggacgccagggagaggg

SEQ ID NO: 7180 - DNA, 20 bp, Artificial
  20-mer unique DNA sequence
tggaagcagggaccgggaat

SEQ ID NO: 7181 - DNA, 20 bp, Artificial
  20-mer unique DNA sequence
ccgcggctccttcgttctat

SEQ ID NO: 7182 - DNA, 20 bp, Artificial
  20-mer unique DNA sequence
tttccgcggctttttgtgcg

SEQ ID NO: 7183 - DNA, 20 bp, Artificial
  20-mer unique DNA sequence
gcgtctcggtgtgctgccta

SEQ ID NO: 7184 - DNA, 20 bp, Artificial
  20-mer unique DNA sequence
ttgggctcttgcagtggggt

SEQ ID NO: 7185 - DNA, 20 bp, Artificial
  20-mer unique DNA sequence
gggttcggttgccaggggta

SEQ ID NO: 7186 - DNA, 20 bp, Artificial
  20-mer unique DNA sequence
ggtggtgagggagctcgtcg

SEQ ID NO: 7187 - DNA, 20 bp, Artificial
  20-mer unique DNA sequence
aggaacccgcgcaagcagat

SEQ ID NO: 7188 - DNA, 20 bp, Artificial
  20-mer unique DNA sequence
caatatgcctggaaccgccg

SEQ ID NO: 7189 - DNA, 20 bp, Artificial
  20-mer unique DNA sequence
ccacatgcccctcccaacga

SEQ ID NO: 7190 - DNA, 20 bp, Artificial
  20-mer unique DNA sequence
tcggacccacaaaagacggg

SEQ ID NO: 7191 - DNA, 20 bp, Artificial
  20-mer unique DNA sequence
tcatgcctgtggctttcgca

SEQ ID NO: 7192 - DNA, 20 bp, Artificial
  20-mer unique DNA sequence
ggtcgggcagaagggattcg

SEQ ID NO: 7193 - DNA, 20 bp, Artificial
  20-mer unique DNA sequence
accgaactctcgacggtcct

SEQ ID NO: 7194 - DNA, 20 bp, Artificial
  20-mer unique DNA sequence
ctcttgcgatcggggctcct

SEQ ID NO: 7195 - DNA, 20 bp, Artificial
  20-mer unique DNA sequence
aggtcaggcggggagggtca

SEQ ID NO: 7196 - DNA, 20 bp, Artificial
  20-mer unique DNA sequence
acgtccagccagccagtccc

SEQ ID NO: 7197 - DNA, 20 bp, Artificial
  20-mer unique DNA sequence
agctagcgcaaccgatcccg

SEQ ID NO: 7198 - DNA, 20 bp, Artificial
  20-mer unique DNA sequence
tcaaggagcttcagcgcggt

SEQ ID NO: 7199 - DNA, 20 bp, Artificial
  20-mer unique DNA sequence
gcttttaaccgcttggggcg

SEQ ID NO: 7200 - DNA, 20 bp, Artificial
  20-mer unique DNA sequence
tactgcacgaccgccgacaa

SEQ ID NO: 7201 - DNA, 20 bp, Artificial
  20-mer unique DNA sequence
tccggaaatcaagcacgcaa

SEQ ID NO: 7202 - DNA, 20 bp, Artificial
  20-mer unique DNA sequence
ccgaacctcccgatcaatgc

SEQ ID NO: 7203 - DNA, 20 bp, Artificial
  20-mer unique DNA sequence
gatggtctcggttcgggagg

SEQ ID NO: 7204 - DNA, 20 bp, Artificial
  20-mer unique DNA sequence
ggggaacacaggaccaggga

SEQ ID NO: 7205 - DNA, 20 bp, Artificial
  20-mer unique DNA sequence
acaagggcccggaaatgagc

SEQ ID NO: 7206 - DNA, 20 bp, Artificial
  20-mer unique DNA sequence
accggtagcccgtttttcga

SEQ ID NO: 7207 - DNA, 20 bp, Artificial
  20-mer unique DNA sequence
tttggacgagcctcgcgacg

SEQ ID NO: 7208 - DNA, 20 bp, Artificial
  20-mer unique DNA sequence
tgcgtggtgaaatggggcat

SEQ ID NO: 7209 - DNA, 20 bp, Artificial
  20-mer unique DNA sequence
ggctggcttcggttaggtgc

SEQ ID NO: 7210 - DNA, 20 bp, Artificial
  20-mer unique DNA sequence
acggagtggttgcgaggcga

SEQ ID NO: 7211 - DNA, 20 bp, Artificial
  20-mer unique DNA sequence
tcgctcccctcgcacagata

SEQ ID NO: 7212 - DNA, 20 bp, Artificial
  20-mer unique DNA sequence
agcaagctggtcacgtcacg

SEQ ID NO: 7213 - DNA, 20 bp, Artificial
  20-mer unique DNA sequence
cccatgcgggctacaagtcg

SEQ ID NO: 7214 - DNA, 20 bp, Artificial
  20-mer unique DNA sequence
aaggggagcagacggaggag

SEQ ID NO: 7215 - DNA, 20 bp, Artificial
  20-mer unique DNA sequence
cgccactagcgctcattccc

SEQ ID NO: 7216 - DNA, 20 bp, Artificial
  20-mer unique DNA sequence
cccttgcggcgtgttggaat

SEQ ID NO: 7217 - DNA, 20 bp, Artificial
  20-mer unique DNA sequence
tacgggctcttttttggcgg

SEQ ID NO: 7218 - DNA, 20 bp, Artificial
  20-mer unique DNA sequence
ataggttttgcatcgccgcg

SEQ ID NO: 7219 - DNA, 20 bp, Artificial
  20-mer unique DNA sequence
aactttggtccgcgctcgag

SEQ ID NO: 7220 - DNA, 20 bp, Artificial
  20-mer unique DNA sequence
tccgcgtggcaaaactcttc

SEQ ID NO: 7221 - DNA, 20 bp, Artificial
  20-mer unique DNA sequence
ccagcaagacacgcgctccg

SEQ ID NO: 7222 - DNA, 20 bp, Artificial
  20-mer unique DNA sequence
acctcgcaatccccagcaac

SEQ ID NO: 7223 - DNA, 20 bp, Artificial
  20-mer unique DNA sequence
catttacccgctgccccact

SEQ ID NO: 7224 - DNA, 20 bp, Artificial
  20-mer unique DNA sequence
tgagggttcgagccgggagt

SEQ ID NO: 7225 - DNA, 20 bp, Artificial
  20-mer unique DNA sequence
gccttccccacccaagtcaa

SEQ ID NO: 7226 - DNA, 20 bp, Artificial
  20-mer unique DNA sequence
caagccaaggcgagcccctg

SEQ ID NO: 7227 - DNA, 20 bp, Artificial
  20-mer unique DNA sequence
tttcattgccagcgtccaag

SEQ ID NO: 7228 - DNA, 20 bp, Artificial
  20-mer unique DNA sequence
gacattaagaggaccgcggg

SEQ ID NO: 7229 - DNA, 20 bp, Artificial
  20-mer unique DNA sequence
cagcaagcggcggaatatcg

SEQ ID NO: 7230 - DNA, 20 bp, Artificial
  20-mer unique DNA sequence
tcttcgtggcggttctgtgc

SEQ ID NO: 7231 - DNA, 20 bp, Artificial
  20-mer unique DNA sequence
aggacgcgacgggcaggaat

SEQ ID NO: 7232 - DNA, 20 bp, Artificial
  20-mer unique DNA sequence
caagccctggctaagaccca

SEQ ID NO: 7233 - DNA, 20 bp, Artificial
  20-mer unique DNA sequence
tgatcgtgcgacgtcaagga

SEQ ID NO: 7234 - DNA, 20 bp, Artificial
  20-mer unique DNA sequence
gcggtgcttgtgatgcttgc

SEQ ID NO: 7235 - DNA, 20 bp, Artificial
  20-mer unique DNA sequence
atgcgccgatgttccttggt

SEQ ID NO: 7236 - DNA, 20 bp, Artificial
  20-mer unique DNA sequence
gcccggtgtcgtacgtctta

SEQ ID NO: 7237 - DNA, 20 bp, Artificial
  20-mer unique DNA sequence
ttccgtacggctaccccagt

SEQ ID NO: 7238 - DNA, 20 bp, Artificial
  20-mer unique DNA sequence
ctcgcccgacggctcctaat

SEQ ID NO: 7239 - DNA, 20 bp, Artificial
  20-mer unique DNA sequence
gcagcgagcttaacggggag

SEQ ID NO: 7240 - DNA, 20 bp, Artificial
  20-mer unique DNA sequence
gggggaagtcaggtgtgcgc

SEQ ID NO: 7241 - DNA, 20 bp, Artificial
  20-mer unique DNA sequence
gatacccctccgcattggcc

SEQ ID NO: 7242 - DNA, 20 bp, Artificial
  20-mer unique DNA sequence
tggtcgtggttcgctggatg

SEQ ID NO: 7243 - DNA, 20 bp, Artificial
  20-mer unique DNA sequence
taaggcgccaggggggagag

SEQ ID NO: 7244 - DNA, 20 bp, Artificial
  20-mer unique DNA sequence
cattcgggagccggttgagg

SEQ ID NO: 7245 - DNA, 20 bp, Artificial
  20-mer unique DNA sequence
agcagcccatcgagcccagt

SEQ ID NO: 7246 - DNA, 20 bp, Artificial
  20-mer unique DNA sequence
gcttctcgaccctccctgca

SEQ ID NO: 7247 - DNA, 20 bp, Artificial
  20-mer unique DNA sequence
gtgtccgcccctccaaagtg

SEQ ID NO: 7248 - DNA, 20 bp, Artificial
  20-mer unique DNA sequence
gaccctacacgtcaagcgga

SEQ ID NO: 7249 - DNA, 20 bp, Artificial
  20-mer unique DNA sequence
gtcgtgtatgagcgtcggga

SEQ ID NO: 7250 - DNA, 20 bp, Artificial
  20-mer unique DNA sequence
cgcgcgcacaaacttcgtaa

SEQ ID NO: 7251 - DNA, 20 bp, Artificial
  20-mer unique DNA sequence
gagggggtgctgcctacggc

SEQ ID NO: 7252 - DNA, 20 bp, Artificial
  20-mer unique DNA sequence
ttttggcggctgtgttccgt

SEQ ID NO: 7253 - DNA, 20 bp, Artificial
  20-mer unique DNA sequence
atgtgaactgccccccaccg

SEQ ID NO: 7254 - DNA, 20 bp, Artificial
  20-mer unique DNA sequence
agcaaaaacagccgcggcaa

SEQ ID NO: 7255 - DNA, 20 bp, Artificial
  20-mer unique DNA sequence
aacgttgcacacggctccac

SEQ ID NO: 7256 - DNA, 20 bp, Artificial
  20-mer unique DNA sequence
gcgccggagagaagtgggaa

SEQ ID NO: 7257 - DNA, 20 bp, Artificial
  20-mer unique DNA sequence
ccgcattctcctccgcacct

SEQ ID NO: 7258 - DNA, 20 bp, Artificial
  20-mer unique DNA sequence
ccatttccagacgcttccgc

SEQ ID NO: 7259 - DNA, 20 bp, Artificial
  20-mer unique DNA sequence
ccgccgcatacaaacgccat

SEQ ID NO: 7260 - DNA, 20 bp, Artificial
  20-mer unique DNA sequence
aaaggggcgcggtgtaacgg

SEQ ID NO: 7261 - DNA, 20 bp, Artificial
  20-mer unique DNA sequence
cgtccccttccctcaatccc

SEQ ID NO: 7262 - DNA, 20 bp, Artificial
  20-mer unique DNA sequence
gcaaagctgtgggcggaaga

SEQ ID NO: 7263 - DNA, 20 bp, Artificial
  20-mer unique DNA sequence
ttgaattcggtcacggggga

SEQ ID NO: 7264 - DNA, 20 bp, Artificial
  20-mer unique DNA sequence
ggccgtgggaaggatgtctc

SEQ ID NO: 7265 - DNA, 20 bp, Artificial
  20-mer unique DNA sequence
tcacgcgttttgttggcccc

SEQ ID NO: 7266 - DNA, 20 bp, Artificial
  20-mer unique DNA sequence
ccagggcggctgtcttgaat

SEQ ID NO: 7267 - DNA, 20 bp, Artificial
  20-mer unique DNA sequence
gcccggtacacgtaaccgta

SEQ ID NO: 7268 - DNA, 20 bp, Artificial
  20-mer unique DNA sequence
gtgcagctcgccattcaggt

SEQ ID NO: 7269 - DNA, 20 bp, Artificial
  20-mer unique DNA sequence
aacaggaggcccaaagcacc

SEQ ID NO: 7270 - DNA, 20 bp, Artificial
  20-mer unique DNA sequence
accctagcccgtctccgtcg

SEQ ID NO: 7271 - DNA, 20 bp, Artificial
  20-mer unique DNA sequence
taccatttgtgcctgccccc

SEQ ID NO: 7272 - DNA, 20 bp, Artificial
  20-mer unique DNA sequence
gtggttggagacgtggggcg

SEQ ID NO: 7273 - DNA, 20 bp, Artificial
  20-mer unique DNA sequence
caaactgcatatggcggggg

SEQ ID NO: 7274 - DNA, 20 bp, Artificial
  20-mer unique DNA sequence
gtggatgtgttgggacggcc

SEQ ID NO: 7275 - DNA, 20 bp, Artificial
  20-mer unique DNA sequence
tgaagtggtggtcgtgcccg

SEQ ID NO: 7276 - DNA, 20 bp, Artificial
  20-mer unique DNA sequence
cccacggctcgatcctacca

SEQ ID NO: 7277 - DNA, 20 bp, Artificial
  20-mer unique DNA sequence
gactaacacccggccgcact

SEQ ID NO: 7278 - DNA, 20 bp, Artificial
  20-mer unique DNA sequence
ggggggaagctggggcaata

SEQ ID NO: 7279 - DNA, 20 bp, Artificial
  20-mer unique DNA sequence
cagaggggttagcggtggcc

SEQ ID NO: 7280 - DNA, 20 bp, Artificial
  20-mer unique DNA sequence
gaatctcccgccctccacgt

SEQ ID NO: 7281 - DNA, 20 bp, Artificial
  20-mer unique DNA sequence
tgcgtggaggcttggcgata

SEQ ID NO: 7282 - DNA, 20 bp, Artificial
  20-mer unique DNA sequence
ggaacgggcaggaacatcgg

SEQ ID NO: 7283 - DNA, 20 bp, Artificial
  20-mer unique DNA sequence
cagatggatatgcgcgtgcg

SEQ ID NO: 7284 - DNA, 20 bp, Artificial
  20-mer unique DNA sequence
ccgatgaagaaaccgggcaa

SEQ ID NO: 7285 - DNA, 20 bp, Artificial
  20-mer unique DNA sequence
tagcggagggatgaccggga

SEQ ID NO: 7286 - DNA, 20 bp, Artificial
  20-mer unique DNA sequence
gatgcaacagcaagggcgac

SEQ ID NO: 7287 - DNA, 20 bp, Artificial
  20-mer unique DNA sequence
ttgccgtgtggggtgagtca

SEQ ID NO: 7288 - DNA, 20 bp, Artificial
  20-mer unique DNA sequence
accgccaggccacagtatcc

SEQ ID NO: 7289 - DNA, 20 bp, Artificial
  20-mer unique DNA sequence
gatctggctgtgagggggca

SEQ ID NO: 7290 - DNA, 20 bp, Artificial
  20-mer unique DNA sequence
cggcgctccagtacagggtt

SEQ ID NO: 7291 - DNA, 20 bp, Artificial
  20-mer unique DNA sequence
caatgttagagcacgcccgc

SEQ ID NO: 7292 - DNA, 20 bp, Artificial
  20-mer unique DNA sequence
cgggaatttacggagcggac

SEQ ID NO: 7293 - DNA, 20 bp, Artificial
  20-mer unique DNA sequence
aggccgctgtgtggtttgcg

SEQ ID NO: 7294 - DNA, 20 bp, Artificial
  20-mer unique DNA sequence
caccaaccacccgagcccaa

SEQ ID NO: 7295 - DNA, 20 bp, Artificial
  20-mer unique DNA sequence
cgcctctcttccgttggcat

SEQ ID NO: 7296 - DNA, 20 bp, Artificial
  20-mer unique DNA sequence
tgagcgccccgatagagcaa

SEQ ID NO: 7297 - DNA, 20 bp, Artificial
  20-mer unique DNA sequence
cttggcgctgtacccctttc

SEQ ID NO: 7298 - DNA, 20 bp, Artificial
  20-mer unique DNA sequence
tgcccggatccctagctccc

SEQ ID NO: 7299 - DNA, 20 bp, Artificial
  20-mer unique DNA sequence
gaaaaggtgggcgccaaaga

SEQ ID NO: 7300 - DNA, 20 bp, Artificial
  20-mer unique DNA sequence
cagtatctctccgggccgcc

SEQ ID NO: 7301 - DNA, 20 bp, Artificial
  20-mer unique DNA sequence
agggcgcatcactcggggtt

SEQ ID NO: 7302 - DNA, 20 bp, Artificial
  20-mer unique DNA sequence
aatcagccccgacaccgatc

SEQ ID NO: 7303 - DNA, 20 bp, Artificial
  20-mer unique DNA sequence
taaccggccatcaacgggat

SEQ ID NO: 7304 - DNA, 20 bp, Artificial
  20-mer unique DNA sequence
ctgcgtacctgcatccgtcg

SEQ ID NO: 7305 - DNA, 20 bp, Artificial
  20-mer unique DNA sequence
cctgacgcgccccttacgac

SEQ ID NO: 7306 - DNA, 20 bp, Artificial
  20-mer unique DNA sequence
cccgaatacgccacccaatg

SEQ ID NO: 7307 - DNA, 20 bp, Artificial
  20-mer unique DNA sequence
gtttcgcgttcggggtctgt

SEQ ID NO: 7308 - DNA, 20 bp, Artificial
  20-mer unique DNA sequence
ccactccatcatcccgctgc

SEQ ID NO: 7309 - DNA, 20 bp, Artificial
  20-mer unique DNA sequence
gcaccaccggcctacaatga

SEQ ID NO: 7310 - DNA, 20 bp, Artificial
  20-mer unique DNA sequence
ggggcaacaacgacctggag

SEQ ID NO: 7311 - DNA, 20 bp, Artificial
  20-mer unique DNA sequence
gaagcaggggagcgggtgag

SEQ ID NO: 7312 - DNA, 20 bp, Artificial
  20-mer unique DNA sequence
gcttggcaggcccgattaca

SEQ ID NO: 7313 - DNA, 20 bp, Artificial
  20-mer unique DNA sequence
gggggcttgaaccgggatga

SEQ ID NO: 7314 - DNA, 20 bp, Artificial
  20-mer unique DNA sequence
ggcaaaaagtggggcagggt

SEQ ID NO: 7315 - DNA, 20 bp, Artificial
  20-mer unique DNA sequence
acccaggaaccaccaagcga

SEQ ID NO: 7316 - DNA, 20 bp, Artificial
  20-mer unique DNA sequence
taccaaacgcgacggaagcc

SEQ ID NO: 7317 - DNA, 20 bp, Artificial
  20-mer unique DNA sequence
tcctgtttatgccgagccgg

SEQ ID NO: 7318 - DNA, 20 bp, Artificial
  20-mer unique DNA sequence
caaatgctaacaggcgcggc

SEQ ID NO: 7319 - DNA, 20 bp, Artificial
  20-mer unique DNA sequence
accaagcacagcgcaactcg

SEQ ID NO: 7320 - DNA, 20 bp, Artificial
  20-mer unique DNA sequence
caccgacgagcaggcgataa

SEQ ID NO: 7321 - DNA, 20 bp, Artificial
  20-mer unique DNA sequence
taggtgttggggctttgcgg

SEQ ID NO: 7322 - DNA, 20 bp, Artificial
  20-mer unique DNA sequence
cgtttgattcgggatggcca

SEQ ID NO: 7323 - DNA, 20 bp, Artificial
  20-mer unique DNA sequence
cggttgggctgctcgtgatc

SEQ ID NO: 7324 - DNA, 20 bp, Artificial
  20-mer unique DNA sequence
gttcccttcccggcttgtgg

SEQ ID NO: 7325 - DNA, 20 bp, Artificial
  20-mer unique DNA sequence
cacagcaccgagcaccatga

SEQ ID NO: 7326 - DNA, 20 bp, Artificial
  20-mer unique DNA sequence
aacttgtggacgggggggct

SEQ ID NO: 7327 - DNA, 20 bp, Artificial
  20-mer unique DNA sequence
tgtgccagtgtcctggatcg

SEQ ID NO: 7328 - DNA, 20 bp, Artificial
  20-mer unique DNA sequence
gtaggggggtgcggttaggg

SEQ ID NO: 7329 - DNA, 20 bp, Artificial
  20-mer unique DNA sequence
ccccaatcgctctgccacaa

SEQ ID NO: 7330 - DNA, 20 bp, Artificial
  20-mer unique DNA sequence
gggcgggcgaaaggttactc

SEQ ID NO: 7331 - DNA, 20 bp, Artificial
  20-mer unique DNA sequence
tttgagcgcttcgaccccga

SEQ ID NO: 7332 - DNA, 20 bp, Artificial
  20-mer unique DNA sequence
acggggggtgttgttggtgg

SEQ ID NO: 7333 - DNA, 20 bp, Artificial
  20-mer unique DNA sequence
agctgggtgtggcgaggtta

SEQ ID NO: 7334 - DNA, 20 bp, Artificial
  20-mer unique DNA sequence
agtccccggcagtcgataag

SEQ ID NO: 7335 - DNA, 20 bp, Artificial
  20-mer unique DNA sequence
taatcggtgctgggaacggc

SEQ ID NO: 7336 - DNA, 20 bp, Artificial
  20-mer unique DNA sequence
cgggtacgctaagaggtgct

SEQ ID NO: 7337 - DNA, 20 bp, Artificial
  20-mer unique DNA sequence
gagggggctttcggccaact

SEQ ID NO: 7338 - DNA, 20 bp, Artificial
  20-mer unique DNA sequence
actccgctcccttcccccac

SEQ ID NO: 7339 - DNA, 20 bp, Artificial
  20-mer unique DNA sequence
tgtacatcacggcccgagtg

SEQ ID NO: 7340 - DNA, 20 bp, Artificial
  20-mer unique DNA sequence
aacacgcgttgccgatctca

SEQ ID NO: 7341 - DNA, 20 bp, Artificial
  20-mer unique DNA sequence
tccgagcgggtcatgaaagg

SEQ ID NO: 7342 - DNA, 20 bp, Artificial
  20-mer unique DNA sequence
agaccccgacgctaccgctt

SEQ ID NO: 7343 - DNA, 20 bp, Artificial
  20-mer unique DNA sequence
aatcttgggtgcgtcggggg

SEQ ID NO: 7344 - DNA, 20 bp, Artificial
  20-mer unique DNA sequence
ccatcacgcaaccactcgcc

SEQ ID NO: 7345 - DNA, 20 bp, Artificial
  20-mer unique DNA sequence
cctccaccccgtcagcctca

SEQ ID NO: 7346 - DNA, 20 bp, Artificial
  20-mer unique DNA sequence
gaggggccgggtggagtaga

SEQ ID NO: 7347 - DNA, 20 bp, Artificial
  20-mer unique DNA sequence
ctgctgctcccgtcccccat

SEQ ID NO: 7348 - DNA, 20 bp, Artificial
  20-mer unique DNA sequence
ggggacacaggcaaaacggg

SEQ ID NO: 7349 - DNA, 20 bp, Artificial
  20-mer unique DNA sequence
ccgcacaggacaaacacgca

SEQ ID NO: 7350 - DNA, 20 bp, Artificial
  20-mer unique DNA sequence
actgaaggaccaagcgcgga

SEQ ID NO: 7351 - DNA, 20 bp, Artificial
  20-mer unique DNA sequence
gagacccatttccggatgat

SEQ ID NO: 7352 - DNA, 20 bp, Artificial
  20-mer unique DNA sequence
tggcgggctgagggactttg

SEQ ID NO: 7353 - DNA, 20 bp, Artificial
  20-mer unique DNA sequence
ttttgtcccttttcccgccg

SEQ ID NO: 7354 - DNA, 20 bp, Artificial
  20-mer unique DNA sequence
ccaatccactcctgctgcga

SEQ ID NO: 7355 - DNA, 20 bp, Artificial
  20-mer unique DNA sequence
cacacccgcacaaccccaat

SEQ ID NO: 7356 - DNA, 20 bp, Artificial
  20-mer unique DNA sequence
cgaaaacctcacgcccgcag

SEQ ID NO: 7357 - DNA, 20 bp, Artificial
  20-mer unique DNA sequence
tcaccgatacccagccaacg

SEQ ID NO: 7358 - DNA, 20 bp, Artificial
  20-mer unique DNA sequence
cgcgaacacggcatggtaga

SEQ ID NO: 7359 - DNA, 20 bp, Artificial
  20-mer unique DNA sequence
tctcgcgcggtccatccata

SEQ ID NO: 7360 - DNA, 20 bp, Artificial
  20-mer unique DNA sequence
ttagtgatttcgcgcccggt

SEQ ID NO: 7361 - DNA, 20 bp, Artificial
  20-mer unique DNA sequence
ctgggtctggaattagcggc

SEQ ID NO: 7362 - DNA, 20 bp, Artificial
  20-mer unique DNA sequence
ggagcccccgaaaggcgata

SEQ ID NO: 7363 - DNA, 20 bp, Artificial
  20-mer unique DNA sequence
gcccgatcacgtacagccgc

SEQ ID NO: 7364 - DNA, 20 bp, Artificial
  20-mer unique DNA sequence
aaatgaacgggtggcggctt

SEQ ID NO: 7365 - DNA, 20 bp, Artificial
  20-mer unique DNA sequence
ctgccacccctccgaaacag

SEQ ID NO: 7366 - DNA, 20 bp, Artificial
  20-mer unique DNA sequence
cctccttcccaccctcgcag

SEQ ID NO: 7367 - DNA, 20 bp, Artificial
  20-mer unique DNA sequence
ccgttatcctcagcccgtgc

SEQ ID NO: 7368 - DNA, 20 bp, Artificial
  20-mer unique DNA sequence
gggcccatcgtcggtcagtc

SEQ ID NO: 7369 - DNA, 20 bp, Artificial
  20-mer unique DNA sequence
cgccagcggggggagtaagt

SEQ ID NO: 7370 - DNA, 20 bp, Artificial
  20-mer unique DNA sequence
tagcggcggtgcagatcaag

SEQ ID NO: 7371 - DNA, 20 bp, Artificial
  20-mer unique DNA sequence
agcaggaggttgtgggccga

SEQ ID NO: 7372 - DNA, 20 bp, Artificial
  20-mer unique DNA sequence
gggccgacgtatgtgggtaa

SEQ ID NO: 7373 - DNA, 20 bp, Artificial
  20-mer unique DNA sequence
tgactagcgtccacgtcacc

SEQ ID NO: 7374 - DNA, 20 bp, Artificial
  20-mer unique DNA sequence
gggtaggcaggggagtgggc

SEQ ID NO: 7375 - DNA, 20 bp, Artificial
  20-mer unique DNA sequence
atcttttggctcgcgcgtcg

SEQ ID NO: 7376 - DNA, 20 bp, Artificial
  20-mer unique DNA sequence
agggcgggggcgacttgtat

SEQ ID NO: 7377 - DNA, 20 bp, Artificial
  20-mer unique DNA sequence
ttgggggtatcgtggcatgc

SEQ ID NO: 7378 - DNA, 20 bp, Artificial
  20-mer unique DNA sequence
actaaccatcgcaccggcca

SEQ ID NO: 7379 - DNA, 20 bp, Artificial
  20-mer unique DNA sequence
gtggccaacctccccgctct

SEQ ID NO: 7380 - DNA, 20 bp, Artificial
  20-mer unique DNA sequence
cttgccagccctttgccgtg

SEQ ID NO: 7381 - DNA, 20 bp, Artificial
  20-mer unique DNA sequence
gcccgggagaggactcgaca

SEQ ID NO: 7382 - DNA, 20 bp, Artificial
  20-mer unique DNA sequence
gttgcgcgatggttgaggtg

SEQ ID NO: 7383 - DNA, 20 bp, Artificial
  20-mer unique DNA sequence
agtttcggcgggggtcagag

SEQ ID NO: 7384 - DNA, 20 bp, Artificial
  20-mer unique DNA sequence
tgcatatgggacgaggggga

SEQ ID NO: 7385 - DNA, 20 bp, Artificial
  20-mer unique DNA sequence
agggtttgggcgtttgcggt

SEQ ID NO: 7386 - DNA, 20 bp, Artificial
  20-mer unique DNA sequence
aattttggaaccgcgcctca

SEQ ID NO: 7387 - DNA, 20 bp, Artificial
  20-mer unique DNA sequence
aggggtgtgcaaaggtccgg

SEQ ID NO: 7388 - DNA, 20 bp, Artificial
  20-mer unique DNA sequence
ttggcggggagagaaccttg

SEQ ID NO: 7389 - DNA, 20 bp, Artificial
  20-mer unique DNA sequence
tagccgagacgcccacgacc

SEQ ID NO: 7390 - DNA, 20 bp, Artificial
  20-mer unique DNA sequence
tatcttcgtgcgccgtcgtg

SEQ ID NO: 7391 - DNA, 20 bp, Artificial
  20-mer unique DNA sequence
gggacgatcggcaagcagga

SEQ ID NO: 7392 - DNA, 20 bp, Artificial
  20-mer unique DNA sequence
gcgccggccacagtatgatc

SEQ ID NO: 7393 - DNA, 20 bp, Artificial
  20-mer unique DNA sequence
ggggcttcgttcgcggactt

SEQ ID NO: 7394 - DNA, 20 bp, Artificial
  20-mer unique DNA sequence
tgcgaaaccgtgattcggct

SEQ ID NO: 7395 - DNA, 20 bp, Artificial
  20-mer unique DNA sequence
agcaaatgcggactgcctgt

SEQ ID NO: 7396 - DNA, 20 bp, Artificial
  20-mer unique DNA sequence
aattagcccccgtgcactcg

SEQ ID NO: 7397 - DNA, 20 bp, Artificial
  20-mer unique DNA sequence
ggttagggcgcgctttcgag

SEQ ID NO: 7398 - DNA, 20 bp, Artificial
  20-mer unique DNA sequence
acaaccatcctgcacgccca

SEQ ID NO: 7399 - DNA, 20 bp, Artificial
  20-mer unique DNA sequence
ccgtggtcgtatgtgcgctt

SEQ ID NO: 7400 - DNA, 20 bp, Artificial
  20-mer unique DNA sequence
cgcggttacgattggcacag

SEQ ID NO: 7401 - DNA, 20 bp, Artificial
  20-mer unique DNA sequence
tgttcgggggctgtgatgca

SEQ ID NO: 7402 - DNA, 20 bp, Artificial
  20-mer unique DNA sequence
gagaacggcaggctatgggg

SEQ ID NO: 7403 - DNA, 20 bp, Artificial
  20-mer unique DNA sequence
gaacttgcttgtcgcgcggc

SEQ ID NO: 7404 - DNA, 20 bp, Artificial
  20-mer unique DNA sequence
taacgtcgggtcgaggcacc

SEQ ID NO: 7405 - DNA, 20 bp, Artificial
  20-mer unique DNA sequence
cgcctgtcggttggggagta

SEQ ID NO: 7406 - DNA, 20 bp, Artificial
  20-mer unique DNA sequence
tactggtgtgcctttgccgg

SEQ ID NO: 7407 - DNA, 20 bp, Artificial
  20-mer unique DNA sequence
gacgggctttagggcacagg

SEQ ID NO: 7408 - DNA, 20 bp, Artificial
  20-mer unique DNA sequence
cacctaaccgacccacgccg

SEQ ID NO: 7409 - DNA, 20 bp, Artificial
  20-mer unique DNA sequence
gagggggtgacggaggttcg

SEQ ID NO: 7410 - DNA, 20 bp, Artificial
  20-mer unique DNA sequence
taaaaggggggccgaaagcg

SEQ ID NO: 7411 - DNA, 20 bp, Artificial
  20-mer unique DNA sequence
gactcctgccgcccacctcc

SEQ ID NO: 7412 - DNA, 20 bp, Artificial
  20-mer unique DNA sequence
tgcgcgatctgtcatcctgg

SEQ ID NO: 7413 - DNA, 20 bp, Artificial
  20-mer unique DNA sequence
aagccatgtccgctcggaag

SEQ ID NO: 7414 - DNA, 20 bp, Artificial
  20-mer unique DNA sequence
gacaaccccactcgcaggcc

SEQ ID NO: 7415 - DNA, 20 bp, Artificial
  20-mer unique DNA sequence
aacaaggaaacccccgccat

SEQ ID NO: 7416 - DNA, 20 bp, Artificial
  20-mer unique DNA sequence
gcccgcttattttcgccatg

SEQ ID NO: 7417 - DNA, 20 bp, Artificial
  20-mer unique DNA sequence
gttgggggacggagcgcttt

SEQ ID NO: 7418 - DNA, 20 bp, Artificial
  20-mer unique DNA sequence
cccatgctctgcccactcct

SEQ ID NO: 7419 - DNA, 20 bp, Artificial
  20-mer unique DNA sequence
cggcggaggaattggtgcag

SEQ ID NO: 7420 - DNA, 20 bp, Artificial
  20-mer unique DNA sequence
cagtcagcactcaggcagca

SEQ ID NO: 7421 - DNA, 20 bp, Artificial
  20-mer unique DNA sequence
tccccggtcccttcaactgg

SEQ ID NO: 7422 - DNA, 20 bp, Artificial
  20-mer unique DNA sequence
gccggggtcaagatgggcta

SEQ ID NO: 7423 - DNA, 20 bp, Artificial
  20-mer unique DNA sequence
ccactggtgaagcggcggag

SEQ ID NO: 7424 - DNA, 20 bp, Artificial
  20-mer unique DNA sequence
ctatcgcttacacccccgcc

SEQ ID NO: 7425 - DNA, 20 bp, Artificial
  20-mer unique DNA sequence
cccagcgctacttcgttccc

SEQ ID NO: 7426 - DNA, 20 bp, Artificial
  20-mer unique DNA sequence
gtcgtagatcttcgccgcgc

SEQ ID NO: 7427 - DNA, 20 bp, Artificial
  20-mer unique DNA sequence
ctcggtgttgtttggccccc

SEQ ID NO: 7428 - DNA, 20 bp, Artificial
  20-mer unique DNA sequence
tgcgggtatcgaacgggagt

SEQ ID NO: 7429 - DNA, 20 bp, Artificial
  20-mer unique DNA sequence
tgccccgcaccaatactacg

SEQ ID NO: 7430 - DNA, 20 bp, Artificial
  20-mer unique DNA sequence
atgggactttggagggcgca

SEQ ID NO: 7431 - DNA, 20 bp, Artificial
  20-mer unique DNA sequence
tgagcttgcaccgcgattgc

SEQ ID NO: 7432 - DNA, 20 bp, Artificial
  20-mer unique DNA sequence
cccctgttttggtcctctgc

SEQ ID NO: 7433 - DNA, 20 bp, Artificial
  20-mer unique DNA sequence
tcaaccagccgattcccagg

SEQ ID NO: 7434 - DNA, 20 bp, Artificial
  20-mer unique DNA sequence
ggcgcactaccgacaacccc

SEQ ID NO: 7435 - DNA, 20 bp, Artificial
  20-mer unique DNA sequence
ctgcgtccctggtccctcat

SEQ ID NO: 7436 - DNA, 20 bp, Artificial
  20-mer unique DNA sequence
agctgcctatgagctcgcac

SEQ ID NO: 7437 - DNA, 20 bp, Artificial
  20-mer unique DNA sequence
acaggctagcgaccctccat

SEQ ID NO: 7438 - DNA, 20 bp, Artificial
  20-mer unique DNA sequence
acgatccgtcccgctagcct

SEQ ID NO: 7439 - DNA, 20 bp, Artificial
  20-mer unique DNA sequence
ggggtgagaggcgggttagg

SEQ ID NO: 7440 - DNA, 20 bp, Artificial
  20-mer unique DNA sequence
gtttttgactccgcgcctgg

SEQ ID NO: 7441 - DNA, 20 bp, Artificial
  20-mer unique DNA sequence
tgtgcctacacacagtgggg

SEQ ID NO: 7442 - DNA, 20 bp, Artificial
  20-mer unique DNA sequence
gaagcctgccgaccacccaa

SEQ ID NO: 7443 - DNA, 20 bp, Artificial
  20-mer unique DNA sequence
aagggtgcggatgaaggacg

SEQ ID NO: 7444 - DNA, 20 bp, Artificial
  20-mer unique DNA sequence
tcaaacaccgccacgaacca

SEQ ID NO: 7445 - DNA, 20 bp, Artificial
  20-mer unique DNA sequence
ggggcaggtagatgggcagg

SEQ ID NO: 7446 - DNA, 20 bp, Artificial
  20-mer unique DNA sequence
gtttttacgaccgctgcgca

SEQ ID NO: 7447 - DNA, 20 bp, Artificial
  20-mer unique DNA sequence
cgtttcccggtgcgtatctg

SEQ ID NO: 7448 - DNA, 20 bp, Artificial
  20-mer unique DNA sequence
atgcttaggcctggttgcgg

SEQ ID NO: 7449 - DNA, 20 bp, Artificial
  20-mer unique DNA sequence
cccacccggcgacagaaatt

SEQ ID NO: 7450 - DNA, 20 bp, Artificial
  20-mer unique DNA sequence
cgcttactcgcgctgtacaa

SEQ ID NO: 7451 - DNA, 20 bp, Artificial
  20-mer unique DNA sequence
cccggtacggctggatacaa

SEQ ID NO: 7452 - DNA, 20 bp, Artificial
  20-mer unique DNA sequence
ggtgccaaagacaggcggaa

SEQ ID NO: 7453 - DNA, 20 bp, Artificial
  20-mer unique DNA sequence
gctttggtgccttgggctgc

SEQ ID NO: 7454 - DNA, 20 bp, Artificial
  20-mer unique DNA sequence
acgcagactcgcgttgacga

SEQ ID NO: 7455 - DNA, 20 bp, Artificial
  20-mer unique DNA sequence
tctggctcacggctgtacaa

SEQ ID NO: 7456 - DNA, 20 bp, Artificial
  20-mer unique DNA sequence
cctaacggccgctgaacgaa

SEQ ID NO: 7457 - DNA, 20 bp, Artificial
  20-mer unique DNA sequence
tgatgacgcccggtggaaga

SEQ ID NO: 7458 - DNA, 20 bp, Artificial
  20-mer unique DNA sequence
tgcccaacattacccacgga

SEQ ID NO: 7459 - DNA, 20 bp, Artificial
  20-mer unique DNA sequence
tcgtactggtctggggtttg

SEQ ID NO: 7460 - DNA, 20 bp, Artificial
  20-mer unique DNA sequence
cgaggtacgcgtagccaaca

SEQ ID NO: 7461 - DNA, 20 bp, Artificial
  20-mer unique DNA sequence
accgcagggactctcacgta

SEQ ID NO: 7462 - DNA, 20 bp, Artificial
  20-mer unique DNA sequence
ctcagctgcgtgtagcccat

SEQ ID NO: 7463 - DNA, 20 bp, Artificial
  20-mer unique DNA sequence
gtggggctccgcgtgattaa

SEQ ID NO: 7464 - DNA, 20 bp, Artificial
  20-mer unique DNA sequence
tcccaaaaacgccgcacata

SEQ ID NO: 7465 - DNA, 20 bp, Artificial
  20-mer unique DNA sequence
gtggggtttggacggacggt

SEQ ID NO: 7466 - DNA, 20 bp, Artificial
  20-mer unique DNA sequence
gatccgcgagacgccctttt

SEQ ID NO: 7467 - DNA, 20 bp, Artificial
  20-mer unique DNA sequence
caaaagctgccccaagaggg

SEQ ID NO: 7468 - DNA, 20 bp, Artificial
  20-mer unique DNA sequence
aagcattcccaacgcgaggc

SEQ ID NO: 7469 - DNA, 20 bp, Artificial
  20-mer unique DNA sequence
tgggcctcactctgcgggat

SEQ ID NO: 7470 - DNA, 20 bp, Artificial
  20-mer unique DNA sequence
gcccgacggaaaccgatgac

SEQ ID NO: 7471 - DNA, 20 bp, Artificial
  20-mer unique DNA sequence
ccaagtagcccacaccgcaa

SEQ ID NO: 7472 - DNA, 20 bp, Artificial
  20-mer unique DNA sequence
gccgttggagtgcagttccg

SEQ ID NO: 7473 - DNA, 20 bp, Artificial
  20-mer unique DNA sequence
ttgcagttcgctttgccctg

SEQ ID NO: 7474 - DNA, 20 bp, Artificial
  20-mer unique DNA sequence
ggctctgcgggaccaatcag

SEQ ID NO: 7475 - DNA, 20 bp, Artificial
  20-mer unique DNA sequence
gcgcctaaattgccgattgg

SEQ ID NO: 7476 - DNA, 20 bp, Artificial
  20-mer unique DNA sequence
atgtacacgactgcgtcgct

SEQ ID NO: 7477 - DNA, 20 bp, Artificial
  20-mer unique DNA sequence
ccccccgaactgaccccttt

SEQ ID NO: 7478 - DNA, 20 bp, Artificial
  20-mer unique DNA sequence
cctcgaagaacaccgctggc

SEQ ID NO: 7479 - DNA, 20 bp, Artificial
  20-mer unique DNA sequence
ttccgcttcacgcattccgc

SEQ ID NO: 7480 - DNA, 20 bp, Artificial
  20-mer unique DNA sequence
tcctagccccgcacgaacgt

SEQ ID NO: 7481 - DNA, 20 bp, Artificial
  20-mer unique DNA sequence
tttggcccgaaccatcgcta

SEQ ID NO: 7482 - DNA, 20 bp, Artificial
  20-mer unique DNA sequence
tgttgggcttccttcgctgg

SEQ ID NO: 7483 - DNA, 20 bp, Artificial
  20-mer unique DNA sequence
aaaagcccgccaagagacca

SEQ ID NO: 7484 - DNA, 20 bp, Artificial
  20-mer unique DNA sequence
gctggagacgtgcggggata

SEQ ID NO: 7485 - DNA, 20 bp, Artificial
  20-mer unique DNA sequence
caggggtgttggggaaaggc

SEQ ID NO: 7486 - DNA, 20 bp, Artificial
  20-mer unique DNA sequence
gcgggccattgcttttgtca

SEQ ID NO: 7487 - DNA, 20 bp, Artificial
  20-mer unique DNA sequence
acacgttttccccacccccc

SEQ ID NO: 7488 - DNA, 20 bp, Artificial
  20-mer unique DNA sequence
ccggccctatagcacccaaa

SEQ ID NO: 7489 - DNA, 20 bp, Artificial
  20-mer unique DNA sequence
ggcacggcattgggggacta

SEQ ID NO: 7490 - DNA, 20 bp, Artificial
  20-mer unique DNA sequence
gggttgctggggccttctct

SEQ ID NO: 7491 - DNA, 20 bp, Artificial
  20-mer unique DNA sequence
taatcgggaaggcaggctgg

SEQ ID NO: 7492 - DNA, 20 bp, Artificial
  20-mer unique DNA sequence
aaggatgcaagtgtggcggg

SEQ ID NO: 7493 - DNA, 20 bp, Artificial
  20-mer unique DNA sequence
cgccccaagtacagctcccc

SEQ ID NO: 7494 - DNA, 20 bp, Artificial
  20-mer unique DNA sequence
ctcccctcgttcgcaaccac

SEQ ID NO: 7495 - DNA, 20 bp, Artificial
  20-mer unique DNA sequence
ccagggatgaacgggagcca

SEQ ID NO: 7496 - DNA, 20 bp, Artificial
  20-mer unique DNA sequence
cccctacatcccgccaaccg

SEQ ID NO: 7497 - DNA, 20 bp, Artificial
  20-mer unique DNA sequence
cccgccgaaatgagtgccaa

SEQ ID NO: 7498 - DNA, 20 bp, Artificial
  20-mer unique DNA sequence
gcgtttgacggaccaccagt

SEQ ID NO: 7499 - DNA, 20 bp, Artificial
  20-mer unique DNA sequence
gccgcgaagccgaaggtagg

SEQ ID NO: 7500 - DNA, 20 bp, Artificial
  20-mer unique DNA sequence
ggggcggcggaatctttgag

SEQ ID NO: 7501 - DNA, 20 bp, Artificial
  20-mer unique DNA sequence
taccaagcccccattctgcc

SEQ ID NO: 7502 - DNA, 20 bp, Artificial
  20-mer unique DNA sequence
acaaggacatcgcggccaca

SEQ ID NO: 7503 - DNA, 20 bp, Artificial
  20-mer unique DNA sequence
gccccgcgcgattctctact

SEQ ID NO: 7504 - DNA, 20 bp, Artificial
  20-mer unique DNA sequence
tggttattcgcgcgcagcct

SEQ ID NO: 7505 - DNA, 20 bp, Artificial
  20-mer unique DNA sequence
aatagccgccagccgtccag

SEQ ID NO: 7506 - DNA, 20 bp, Artificial
  20-mer unique DNA sequence
cttcaggggcggcttggact

SEQ ID NO: 7507 - DNA, 20 bp, Artificial
  20-mer unique DNA sequence
tttcagcacaggatcccgca

SEQ ID NO: 7508 - DNA, 20 bp, Artificial
  20-mer unique DNA sequence
caacaaagcactcgcggggg

SEQ ID NO: 7509 - DNA, 20 bp, Artificial
  20-mer unique DNA sequence
ctgacggggaggattggcat

SEQ ID NO: 7510 - DNA, 20 bp, Artificial
  20-mer unique DNA sequence
gggatgactggttgaggccg

SEQ ID NO: 7511 - DNA, 20 bp, Artificial
  20-mer unique DNA sequence
gcggaagcacggagagcacc

SEQ ID NO: 7512 - DNA, 20 bp, Artificial
  20-mer unique DNA sequence
tgtacaagacgcgacgggga

SEQ ID NO: 7513 - DNA, 20 bp, Artificial
  20-mer unique DNA sequence
ggcttggctggttccgattc

SEQ ID NO: 7514 - DNA, 20 bp, Artificial
  20-mer unique DNA sequence
ggcccaccgcagtagttcga

SEQ ID NO: 7515 - DNA, 20 bp, Artificial
  20-mer unique DNA sequence
cgcttcgtcattggccatcc

SEQ ID NO: 7516 - DNA, 20 bp, Artificial
  20-mer unique DNA sequence
tggaaacgggacgatagcgg

SEQ ID NO: 7517 - DNA, 20 bp, Artificial
  20-mer unique DNA sequence
atacgtccccctcccccgag

SEQ ID NO: 7518 - DNA, 20 bp, Artificial
  20-mer unique DNA sequence
actaaatcggtgggcgctcg

SEQ ID NO: 7519 - DNA, 20 bp, Artificial
  20-mer unique DNA sequence
gacctgccctcttcacccga

SEQ ID NO: 7520 - DNA, 20 bp, Artificial
  20-mer unique DNA sequence
cgcagcactaccacggaccc

SEQ ID NO: 7521 - DNA, 20 bp, Artificial
  20-mer unique DNA sequence
tccgtcatccccatccgtcg

SEQ ID NO: 7522 - DNA, 20 bp, Artificial
  20-mer unique DNA sequence
atcttacaccgagcgcccct

SEQ ID NO: 7523 - DNA, 20 bp, Artificial
  20-mer unique DNA sequence
tagtatgtcggcgggcggtc

SEQ ID NO: 7524 - DNA, 20 bp, Artificial
  20-mer unique DNA sequence
accgaatactggccgtggga

SEQ ID NO: 7525 - DNA, 20 bp, Artificial
  20-mer unique DNA sequence
tcctgccggtccactcctca

SEQ ID NO: 7526 - DNA, 20 bp, Artificial
  20-mer unique DNA sequence
ggaggcatgattgggtggga

SEQ ID NO: 7527 - DNA, 20 bp, Artificial
  20-mer unique DNA sequence
ggtgaagccggtggaggacg

SEQ ID NO: 7528 - DNA, 20 bp, Artificial
  20-mer unique DNA sequence
gaaggccggccaatcgactt

SEQ ID NO: 7529 - DNA, 20 bp, Artificial
  20-mer unique DNA sequence
ctcgggcctatcacgcgctc

SEQ ID NO: 7530 - DNA, 20 bp, Artificial
  20-mer unique DNA sequence
aggtcggggggggttggaat

SEQ ID NO: 7531 - DNA, 20 bp, Artificial
  20-mer unique DNA sequence
ggggactgggtggagtgagc

SEQ ID NO: 7532 - DNA, 20 bp, Artificial
  20-mer unique DNA sequence
caaaattacgtcgccccccc

SEQ ID NO: 7533 - DNA, 20 bp, Artificial
  20-mer unique DNA sequence
cccacacaccaaaccgcaaa

SEQ ID NO: 7534 - DNA, 20 bp, Artificial
  20-mer unique DNA sequence
tccgttaagcggtcctgcat

SEQ ID NO: 7535 - DNA, 20 bp, Artificial
  20-mer unique DNA sequence
gttttagggtcgtcccgcgt

SEQ ID NO: 7536 - DNA, 20 bp, Artificial
  20-mer unique DNA sequence
cccgcccacatttccactgc

SEQ ID NO: 7537 - DNA, 20 bp, Artificial
  20-mer unique DNA sequence
cggatgggtattgcgaaggg

SEQ ID NO: 7538 - DNA, 20 bp, Artificial
  20-mer unique DNA sequence
ttcggtctttcatggcgcag

SEQ ID NO: 7539 - DNA, 20 bp, Artificial
  20-mer unique DNA sequence
accacgccgcattccacata

SEQ ID NO: 7540 - DNA, 20 bp, Artificial
  20-mer unique DNA sequence
gccggcctttggtgtactgg

SEQ ID NO: 7541 - DNA, 20 bp, Artificial
  20-mer unique DNA sequence
aggagctgggccgggtagtg

SEQ ID NO: 7542 - DNA, 20 bp, Artificial
  20-mer unique DNA sequence
tgatctggggaagcgaaggg

SEQ ID NO: 7543 - DNA, 20 bp, Artificial
  20-mer unique DNA sequence
gggggatgaagcaaacgtgg

SEQ ID NO: 7544 - DNA, 20 bp, Artificial
  20-mer unique DNA sequence
ttgagcccacgaaacgcctg

SEQ ID NO: 7545 - DNA, 20 bp, Artificial
  20-mer unique DNA sequence
ttaggagcgcgcgagtttga

SEQ ID NO: 7546 - DNA, 20 bp, Artificial
  20-mer unique DNA sequence
ctgacgggtccgacgtacaa

SEQ ID NO: 7547 - DNA, 20 bp, Artificial
  20-mer unique DNA sequence
gcgtgaacctggggagaacc

SEQ ID NO: 7548 - DNA, 20 bp, Artificial
  20-mer unique DNA sequence
tcagttgcacgcatttcccg

SEQ ID NO: 7549 - DNA, 20 bp, Artificial
  20-mer unique DNA sequence
ccgatatcttttggggggcg

SEQ ID NO: 7550 - DNA, 20 bp, Artificial
  20-mer unique DNA sequence
cctttacccgcggcccatta

SEQ ID NO: 7551 - DNA, 20 bp, Artificial
  20-mer unique DNA sequence
gcccccctctgttctgatgc

SEQ ID NO: 7552 - DNA, 20 bp, Artificial
  20-mer unique DNA sequence
tgggcggtttcggggagtat

SEQ ID NO: 7553 - DNA, 20 bp, Artificial
  20-mer unique DNA sequence
gcggttcctttggatgggta

SEQ ID NO: 7554 - DNA, 20 bp, Artificial
  20-mer unique DNA sequence
tgaccccatccgcctcttcc

SEQ ID NO: 7555 - DNA, 20 bp, Artificial
  20-mer unique DNA sequence
ccccagtcccctcggttcac

SEQ ID NO: 7556 - DNA, 20 bp, Artificial
  20-mer unique DNA sequence
tattgggcgccggtgggatt

SEQ ID NO: 7557 - DNA, 20 bp, Artificial
  20-mer unique DNA sequence
aagttacagagggggggcgg

SEQ ID NO: 7558 - DNA, 20 bp, Artificial
  20-mer unique DNA sequence
caaagacgtcccgcagcaag

SEQ ID NO: 7559 - DNA, 20 bp, Artificial
  20-mer unique DNA sequence
ccatcagggcggttactggg

SEQ ID NO: 7560 - DNA, 20 bp, Artificial
  20-mer unique DNA sequence
ctcctcccccgccgtctaaa

SEQ ID NO: 7561 - DNA, 20 bp, Artificial
  20-mer unique DNA sequence
aggcggcagggttggattgg

SEQ ID NO: 7562 - DNA, 20 bp, Artificial
  20-mer unique DNA sequence
ggctgaaaacgtgcccgggt

SEQ ID NO: 7563 - DNA, 20 bp, Artificial
  20-mer unique DNA sequence
cccgcttgatcatgtccgcg

SEQ ID NO: 7564 - DNA, 20 bp, Artificial
  20-mer unique DNA sequence
cccctcacaatctcgctccc

SEQ ID NO: 7565 - DNA, 20 bp, Artificial
  20-mer unique DNA sequence
gggggcaaaaagaaccaggc

SEQ ID NO: 7566 - DNA, 20 bp, Artificial
  20-mer unique DNA sequence
cggggaacgccaaaaacgat

SEQ ID NO: 7567 - DNA, 20 bp, Artificial
  20-mer unique DNA sequence
acacccctcacgtcttcgcc

SEQ ID NO: 7568 - DNA, 20 bp, Artificial
  20-mer unique DNA sequence
caaaccacacatcccggcac

SEQ ID NO: 7569 - DNA, 20 bp, Artificial
  20-mer unique DNA sequence
gcccgcgctgccatacttta

SEQ ID NO: 7570 - DNA, 20 bp, Artificial
  20-mer unique DNA sequence
tgcagcagtggcccaagaaa

SEQ ID NO: 7571 - DNA, 20 bp, Artificial
  20-mer unique DNA sequence
cgcgggcgaatagaaggacg

SEQ ID NO: 7572 - DNA, 20 bp, Artificial
  20-mer unique DNA sequence
ccccctgcgccataaacgac

SEQ ID NO: 7573 - DNA, 20 bp, Artificial
  20-mer unique DNA sequence
cccgaaccgcgatccacttt

SEQ ID NO: 7574 - DNA, 20 bp, Artificial
  20-mer unique DNA sequence
ttggggggggagggtactgt

SEQ ID NO: 7575 - DNA, 20 bp, Artificial
  20-mer unique DNA sequence
acgttttgggttgcgagcgg

SEQ ID NO: 7576 - DNA, 20 bp, Artificial
  20-mer unique DNA sequence
tcccgctcgaacgcctgtac

SEQ ID NO: 7577 - DNA, 20 bp, Artificial
  20-mer unique DNA sequence
aaagcacaacggagcagcgg

SEQ ID NO: 7578 - DNA, 20 bp, Artificial
  20-mer unique DNA sequence
accaaaagcgcccgaagaaa

SEQ ID NO: 7579 - DNA, 20 bp, Artificial
  20-mer unique DNA sequence
cgtggtgagggcgcaattgt

SEQ ID NO: 7580 - DNA, 20 bp, Artificial
  20-mer unique DNA sequence
tcagctgttgccctatcgag

SEQ ID NO: 7581 - DNA, 20 bp, Artificial
  20-mer unique DNA sequence
tggtgcacggagcgacttgt

SEQ ID NO: 7582 - DNA, 20 bp, Artificial
  20-mer unique DNA sequence
acgcaacgagccgagtaccg

SEQ ID NO: 7583 - DNA, 20 bp, Artificial
  20-mer unique DNA sequence
tccgggcgctccttcagtca

SEQ ID NO: 7584 - DNA, 20 bp, Artificial
  20-mer unique DNA sequence
ttcgtcccccttctgcggtt

SEQ ID NO: 7585 - DNA, 20 bp, Artificial
  20-mer unique DNA sequence
tgatgccttgacgcctaccg

SEQ ID NO: 7586 - DNA, 20 bp, Artificial
  20-mer unique DNA sequence
gcggagtcgggtgaaatgcg

SEQ ID NO: 7587 - DNA, 20 bp, Artificial
  20-mer unique DNA sequence
gagctacacggcgcgggaaa

SEQ ID NO: 7588 - DNA, 20 bp, Artificial
  20-mer unique DNA sequence
acggcgggcaactccaaaat

SEQ ID NO: 7589 - DNA, 20 bp, Artificial
  20-mer unique DNA sequence
ggtctcctccgcggtttgtc

SEQ ID NO: 7590 - DNA, 20 bp, Artificial
  20-mer unique DNA sequence
cccaaggccccacctcatca

SEQ ID NO: 7591 - DNA, 20 bp, Artificial
  20-mer unique DNA sequence
gcgttggattggcgtttggt

SEQ ID NO: 7592 - DNA, 20 bp, Artificial
  20-mer unique DNA sequence
ggttagcccggggtgatgat

SEQ ID NO: 7593 - DNA, 20 bp, Artificial
  20-mer unique DNA sequence
cgaaggagggcatggaccga

SEQ ID NO: 7594 - DNA, 20 bp, Artificial
  20-mer unique DNA sequence
atgcggcgggggttgtagct

SEQ ID NO: 7595 - DNA, 20 bp, Artificial
  20-mer unique DNA sequence
gtggatggaacagctggcga

SEQ ID NO: 7596 - DNA, 20 bp, Artificial
  20-mer unique DNA sequence
agcggtacgcgactgatctt

SEQ ID NO: 7597 - DNA, 20 bp, Artificial
  20-mer unique DNA sequence
attgagccacggtgcgaaac

SEQ ID NO: 7598 - DNA, 20 bp, Artificial
  20-mer unique DNA sequence
accacgtgggtagcctaacg

SEQ ID NO: 7599 - DNA, 20 bp, Artificial
  20-mer unique DNA sequence
gtgccaccggtacaacgtgt

SEQ ID NO: 7600 - DNA, 20 bp, Artificial
  20-mer unique DNA sequence
aggcaatagggcaaaggcgg

SEQ ID NO: 7601 - DNA, 20 bp, Artificial
  20-mer unique DNA sequence
tctgtctggtggcccctggt

SEQ ID NO: 7602 - DNA, 20 bp, Artificial
  20-mer unique DNA sequence
acaccatgcgcaaaggggct

SEQ ID NO: 7603 - DNA, 20 bp, Artificial
  20-mer unique DNA sequence
tgcgttggtgcgtcggtaac

SEQ ID NO: 7604 - DNA, 20 bp, Artificial
  20-mer unique DNA sequence
tccctgcccttcccggcctg

SEQ ID NO: 7605 - DNA, 20 bp, Artificial
  20-mer unique DNA sequence
acgttggtctccctttgtgc

SEQ ID NO: 7606 - DNA, 20 bp, Artificial
  20-mer unique DNA sequence
ttcgtttagtcccacgcggt

SEQ ID NO: 7607 - DNA, 20 bp, Artificial
  20-mer unique DNA sequence
aagctagcgcgagcgcttag

SEQ ID NO: 7608 - DNA, 20 bp, Artificial
  20-mer unique DNA sequence
tctgattgggtgggggctgt

SEQ ID NO: 7609 - DNA, 20 bp, Artificial
  20-mer unique DNA sequence
ttggatggattggtacgggg

SEQ ID NO: 7610 - DNA, 20 bp, Artificial
  20-mer unique DNA sequence
tggatctcaaggcctgccgt

SEQ ID NO: 7611 - DNA, 20 bp, Artificial
  20-mer unique DNA sequence
cagacgggatggcgtgattg

SEQ ID NO: 7612 - DNA, 20 bp, Artificial
  20-mer unique DNA sequence
gccgacgactgcatgaccca

SEQ ID NO: 7613 - DNA, 20 bp, Artificial
  20-mer unique DNA sequence
tcacaaagagagccggcgca

SEQ ID NO: 7614 - DNA, 20 bp, Artificial
  20-mer unique DNA sequence
cccgcagaccctttcccagt

SEQ ID NO: 7615 - DNA, 20 bp, Artificial
  20-mer unique DNA sequence
gttcgtcggggtggttgctg

SEQ ID NO: 7616 - DNA, 20 bp, Artificial
  20-mer unique DNA sequence
ggggggaagggtcagttgga

SEQ ID NO: 7617 - DNA, 20 bp, Artificial
  20-mer unique DNA sequence
gaaagcgggttgggagggac

SEQ ID NO: 7618 - DNA, 20 bp, Artificial
  20-mer unique DNA sequence
tgataagtcgacgcgcggtt

SEQ ID NO: 7619 - DNA, 20 bp, Artificial
  20-mer unique DNA sequence
gcagtgagtcattcgcgctt

SEQ ID NO: 7620 - DNA, 20 bp, Artificial
  20-mer unique DNA sequence
acgtcatccgtgaggggcta

SEQ ID NO: 7621 - DNA, 20 bp, Artificial
  20-mer unique DNA sequence
tctgtgcagtgagcacctcg

SEQ ID NO: 7622 - DNA, 20 bp, Artificial
  20-mer unique DNA sequence
ggattttcttggaggccccg

SEQ ID NO: 7623 - DNA, 20 bp, Artificial
  20-mer unique DNA sequence
cggtttgcatcgcctcccaa

SEQ ID NO: 7624 - DNA, 20 bp, Artificial
  20-mer unique DNA sequence
cggcattggcgtggttccta

SEQ ID NO: 7625 - DNA, 20 bp, Artificial
  20-mer unique DNA sequence
gctatggggctactcgcgga

SEQ ID NO: 7626 - DNA, 20 bp, Artificial
  20-mer unique DNA sequence
atcgaaactgggggggcaat

SEQ ID NO: 7627 - DNA, 20 bp, Artificial
  20-mer unique DNA sequence
acctacgcgcgcttgacaca

SEQ ID NO: 7628 - DNA, 20 bp, Artificial
  20-mer unique DNA sequence
tggaggtggttcggcggcta

SEQ ID NO: 7629 - DNA, 20 bp, Artificial
  20-mer unique DNA sequence
tttgaggggtttcggcagca

SEQ ID NO: 7630 - DNA, 20 bp, Artificial
  20-mer unique DNA sequence
tgtacacccgcacagcccgt

SEQ ID NO: 7631 - DNA, 20 bp, Artificial
  20-mer unique DNA sequence
atcccagcccgcgttgaaag

SEQ ID NO: 7632 - DNA, 20 bp, Artificial
  20-mer unique DNA sequence
tgcgtccaatagctccgcgg

SEQ ID NO: 7633 - DNA, 20 bp, Artificial
  20-mer unique DNA sequence
gactggacccgcccaaacga

SEQ ID NO: 7634 - DNA, 20 bp, Artificial
  20-mer unique DNA sequence
ggcaacggcaactccaatcg

SEQ ID NO: 7635 - DNA, 20 bp, Artificial
  20-mer unique DNA sequence
cggagggtgggtcgtggatc

SEQ ID NO: 7636 - DNA, 20 bp, Artificial
  20-mer unique DNA sequence
ccctccgactgcctgccttt

SEQ ID NO: 7637 - DNA, 20 bp, Artificial
  20-mer unique DNA sequence
agtctccctgcccgctcaaa

SEQ ID NO: 7638 - DNA, 20 bp, Artificial
  20-mer unique DNA sequence
cgccatttctcacccaacgc

SEQ ID NO: 7639 - DNA, 20 bp, Artificial
  20-mer unique DNA sequence
cgatcccgtttgccttgtga

SEQ ID NO: 7640 - DNA, 20 bp, Artificial
  20-mer unique DNA sequence
cggattggcatttgggtcgg

SEQ ID NO: 7641 - DNA, 20 bp, Artificial
  20-mer unique DNA sequence
ggacgggagcttttgtgggc

SEQ ID NO: 7642 - DNA, 20 bp, Artificial
  20-mer unique DNA sequence
agttccgcgagcgcagttca

SEQ ID NO: 7643 - DNA, 20 bp, Artificial
  20-mer unique DNA sequence
tacccgcgaggaccaggaat

SEQ ID NO: 7644 - DNA, 20 bp, Artificial
  20-mer unique DNA sequence
ggggccgcggaaagagactc

SEQ ID NO: 7645 - DNA, 20 bp, Artificial
  20-mer unique DNA sequence
cccgggaagaaagcgcatgt

SEQ ID NO: 7646 - DNA, 20 bp, Artificial
  20-mer unique DNA sequence
ttcctgggtttgccctctcg

SEQ ID NO: 7647 - DNA, 20 bp, Artificial
  20-mer unique DNA sequence
cggcggacagtttcgtttgg

SEQ ID NO: 7648 - DNA, 20 bp, Artificial
  20-mer unique DNA sequence
cggggctaatcgcgctaggg

SEQ ID NO: 7649 - DNA, 20 bp, Artificial
  20-mer unique DNA sequence
actggctaggcaagacgggc

SEQ ID NO: 7650 - DNA, 20 bp, Artificial
  20-mer unique DNA sequence
tttattgctcgcctccgcgt

SEQ ID NO: 7651 - DNA, 20 bp, Artificial
  20-mer unique DNA sequence
ggccaccggacttatcgccc

SEQ ID NO: 7652 - DNA, 20 bp, Artificial
  20-mer unique DNA sequence
tccgccctcccgagcatcta

SEQ ID NO: 7653 - DNA, 20 bp, Artificial
  20-mer unique DNA sequence
acctcagccctcgtctcccg

SEQ ID NO: 7654 - DNA, 20 bp, Artificial
  20-mer unique DNA sequence
gggtgctgtggtcgggagag

SEQ ID NO: 7655 - DNA, 20 bp, Artificial
  20-mer unique DNA sequence
caatacccgcacatccgcaa

SEQ ID NO: 7656 - DNA, 20 bp, Artificial
  20-mer unique DNA sequence
gcctgcggaattgggggctc

SEQ ID NO: 7657 - DNA, 20 bp, Artificial
  20-mer unique DNA sequence
acgtaaggcggcggggaaaa

SEQ ID NO: 7658 - DNA, 20 bp, Artificial
  20-mer unique DNA sequence
ttgtcggtcctgtgcggtgt

SEQ ID NO: 7659 - DNA, 20 bp, Artificial
  20-mer unique DNA sequence
gtggaaaaggccggggatgc

SEQ ID NO: 7660 - DNA, 20 bp, Artificial
  20-mer unique DNA sequence
aacggtccgtaggctaagcg

SEQ ID NO: 7661 - DNA, 20 bp, Artificial
  20-mer unique DNA sequence
accgatgagtccccccgatc

SEQ ID NO: 7662 - DNA, 20 bp, Artificial
  20-mer unique DNA sequence
tccgccacgttgcacctatg

SEQ ID NO: 7663 - DNA, 20 bp, Artificial
  20-mer unique DNA sequence
cctggggggtattttccgct

SEQ ID NO: 7664 - DNA, 20 bp, Artificial
  20-mer unique DNA sequence
aggtcacggtccgccactta

SEQ ID NO: 7665 - DNA, 20 bp, Artificial
  20-mer unique DNA sequence
agtttgcacggactcgacct

SEQ ID NO: 7666 - DNA, 20 bp, Artificial
  20-mer unique DNA sequence
gcgtcgcgttacctaagcac

SEQ ID NO: 7667 - DNA, 20 bp, Artificial
  20-mer unique DNA sequence
tgagtctagtccggctccga

SEQ ID NO: 7668 - DNA, 20 bp, Artificial
  20-mer unique DNA sequence
gcttagccggccaaacgatg

SEQ ID NO: 7669 - DNA, 20 bp, Artificial
  20-mer unique DNA sequence
tgttgggagtgcgcctgctg

SEQ ID NO: 7670 - DNA, 20 bp, Artificial
  20-mer unique DNA sequence
tgctatggagcgatcggcgt

SEQ ID NO: 7671 - DNA, 20 bp, Artificial
  20-mer unique DNA sequence
ccaggcgagcaccacgaatg

SEQ ID NO: 7672 - DNA, 20 bp, Artificial
  20-mer unique DNA sequence
gagagaaggggcgcgaacat

SEQ ID NO: 7673 - DNA, 20 bp, Artificial
  20-mer unique DNA sequence
acaggcgtggcaaggtaggc

SEQ ID NO: 7674 - DNA, 20 bp, Artificial
  20-mer unique DNA sequence
gcccccaggaccagaaatga

SEQ ID NO: 7675 - DNA, 20 bp, Artificial
  20-mer unique DNA sequence
catcagacccccttgccgtt

SEQ ID NO: 7676 - DNA, 20 bp, Artificial
  20-mer unique DNA sequence
tccccacccagccctctcaa

SEQ ID NO: 7677 - DNA, 20 bp, Artificial
  20-mer unique DNA sequence
catccgacaaaagccccagg

SEQ ID NO: 7678 - DNA, 20 bp, Artificial
  20-mer unique DNA sequence
tagcaaagcgggagcatcgg

SEQ ID NO: 7679 - DNA, 20 bp, Artificial
  20-mer unique DNA sequence
gcagcgccggaaacatgaag

SEQ ID NO: 7680 - DNA, 20 bp, Artificial
  20-mer unique DNA sequence
aagcaggacaggagcgggga

SEQ ID NO: 7681 - DNA, 20 bp, Artificial
  20-mer unique DNA sequence
tcgctgctaatccccccttg

SEQ ID NO: 7682 - DNA, 20 bp, Artificial
  20-mer unique DNA sequence
gagcaaaggcggaaaggcgg

SEQ ID NO: 7683 - DNA, 20 bp, Artificial
  20-mer unique DNA sequence
aaaacgccaacactcgccca

SEQ ID NO: 7684 - DNA, 20 bp, Artificial
  20-mer unique DNA sequence
atgtgatcccgcctttgcgc

SEQ ID NO: 7685 - DNA, 20 bp, Artificial
  20-mer unique DNA sequence
ggctaggcggaggagggctt

SEQ ID NO: 7686 - DNA, 20 bp, Artificial
  20-mer unique DNA sequence
cggcgtagtgggtgaggctg

SEQ ID NO: 7687 - DNA, 20 bp, Artificial
  20-mer unique DNA sequence
cgggcgtgaaagacatgggg

SEQ ID NO: 7688 - DNA, 20 bp, Artificial
  20-mer unique DNA sequence
cctcaggaaccccacacgat

SEQ ID NO: 7689 - DNA, 20 bp, Artificial
  20-mer unique DNA sequence
gcgagcaggcggataggaga

SEQ ID NO: 7690 - DNA, 20 bp, Artificial
  20-mer unique DNA sequence
ttgcggggctcttggatcga

SEQ ID NO: 7691 - DNA, 20 bp, Artificial
  20-mer unique DNA sequence
tcaagacccaccgcctagga

SEQ ID NO: 7692 - DNA, 20 bp, Artificial
  20-mer unique DNA sequence
cataaccgtccgtccccgct

SEQ ID NO: 7693 - DNA, 20 bp, Artificial
  20-mer unique DNA sequence
ggcggaggtgatggtggttc

SEQ ID NO: 7694 - DNA, 20 bp, Artificial
  20-mer unique DNA sequence
acacgagacgcacccatccc

SEQ ID NO: 7695 - DNA, 20 bp, Artificial
  20-mer unique DNA sequence
tcacacgaacccgaagcagg

SEQ ID NO: 7696 - DNA, 20 bp, Artificial
  20-mer unique DNA sequence
ctcgtccctgccttgtgccg

SEQ ID NO: 7697 - DNA, 20 bp, Artificial
  20-mer unique DNA sequence
tctgctctggggctgctgtg

SEQ ID NO: 7698 - DNA, 20 bp, Artificial
  20-mer unique DNA sequence
caatccacgcacaaatcccg

SEQ ID NO: 7699 - DNA, 20 bp, Artificial
  20-mer unique DNA sequence
tctggaggcaggtgggtgga

SEQ ID NO: 7700 - DNA, 20 bp, Artificial
  20-mer unique DNA sequence
catgccgccactccgtgtag

SEQ ID NO: 7701 - DNA, 20 bp, Artificial
  20-mer unique DNA sequence
gctgggcggattcggacgtt

SEQ ID NO: 7702 - DNA, 20 bp, Artificial
  20-mer unique DNA sequence
ttcatttcgctcaccgcccg

SEQ ID NO: 7703 - DNA, 20 bp, Artificial
  20-mer unique DNA sequence
gggggcggaaatggaaactc

SEQ ID NO: 7704 - DNA, 20 bp, Artificial
  20-mer unique DNA sequence
accggcacccctcatgttca

SEQ ID NO: 7705 - DNA, 20 bp, Artificial
  20-mer unique DNA sequence
tgatgatgggaacagggggg

SEQ ID NO: 7706 - DNA, 20 bp, Artificial
  20-mer unique DNA sequence
ccaaccccatcccttttccg

SEQ ID NO: 7707 - DNA, 20 bp, Artificial
  20-mer unique DNA sequence
accaacaatccccgtgtccc

SEQ ID NO: 7708 - DNA, 20 bp, Artificial
  20-mer unique DNA sequence
aacatacggtcgtggcggct

SEQ ID NO: 7709 - DNA, 20 bp, Artificial
  20-mer unique DNA sequence
caacacggctactcgcgcag

SEQ ID NO: 7710 - DNA, 20 bp, Artificial
  20-mer unique DNA sequence
catcgcaaataaccccccgt

SEQ ID NO: 7711 - DNA, 20 bp, Artificial
  20-mer unique DNA sequence
gggactgatgggcgacggac

SEQ ID NO: 7712 - DNA, 20 bp, Artificial
  20-mer unique DNA sequence
tgctaaaaccaccgccacgc

SEQ ID NO: 7713 - DNA, 20 bp, Artificial
  20-mer unique DNA sequence
acgccatgcccccaccagat

SEQ ID NO: 7714 - DNA, 20 bp, Artificial
  20-mer unique DNA sequence
gcgacagtagagggggcgca

SEQ ID NO: 7715 - DNA, 20 bp, Artificial
  20-mer unique DNA sequence
aagacggacacaccgccctg

SEQ ID NO: 7716 - DNA, 20 bp, Artificial
  20-mer unique DNA sequence
ggcgccccatcctgcatctt

SEQ ID NO: 7717 - DNA, 20 bp, Artificial
  20-mer unique DNA sequence
cgcggccccttatacgtcag

SEQ ID NO: 7718 - DNA, 20 bp, Artificial
  20-mer unique DNA sequence
tcagtcatcggcgggcaatt

SEQ ID NO: 7719 - DNA, 20 bp, Artificial
  20-mer unique DNA sequence
gtgggtcgccgttgattcgc

SEQ ID NO: 7720 - DNA, 20 bp, Artificial
  20-mer unique DNA sequence
ggcgacggagcagctaggag

SEQ ID NO: 7721 - DNA, 20 bp, Artificial
  20-mer unique DNA sequence
ccataaggatcgccaacgcc

SEQ ID NO: 7722 - DNA, 20 bp, Artificial
  20-mer unique DNA sequence
tctgagggggtccggtgtcg

SEQ ID NO: 7723 - DNA, 20 bp, Artificial
  20-mer unique DNA sequence
agcagtatcggccggcattc

SEQ ID NO: 7724 - DNA, 20 bp, Artificial
  20-mer unique DNA sequence
ctgttcgatctcccgctccg

SEQ ID NO: 7725 - DNA, 20 bp, Artificial
  20-mer unique DNA sequence
tccggttggggcttgagaat

SEQ ID NO: 7726 - DNA, 20 bp, Artificial
  20-mer unique DNA sequence
actcgtgccgggttgactcg

SEQ ID NO: 7727 - DNA, 20 bp, Artificial
  20-mer unique DNA sequence
cccacttattcggccgagcg

SEQ ID NO: 7728 - DNA, 20 bp, Artificial
  20-mer unique DNA sequence
ccgtgtctagctggggccat

SEQ ID NO: 7729 - DNA, 20 bp, Artificial
  20-mer unique DNA sequence
atcgggtgtatcgcacgaca

SEQ ID NO: 7730 - DNA, 20 bp, Artificial
  20-mer unique DNA sequence
acattacaccaccggcgccc

SEQ ID NO: 7731 - DNA, 20 bp, Artificial
  20-mer unique DNA sequence
aaccccggagcgtcaggata

SEQ ID NO: 7732 - DNA, 20 bp, Artificial
  20-mer unique DNA sequence
cttcgcccgccacctaccct

SEQ ID NO: 7733 - DNA, 20 bp, Artificial
  20-mer unique DNA sequence
cgcacaccaccatcaaccgc

SEQ ID NO: 7734 - DNA, 20 bp, Artificial
  20-mer unique DNA sequence
gggaaaggcgagacacaggc

SEQ ID NO: 7735 - DNA, 20 bp, Artificial
  20-mer unique DNA sequence
ggcccacgtaaatcgcgaca

SEQ ID NO: 7736 - DNA, 20 bp, Artificial
  20-mer unique DNA sequence
accacactatgtcgtggccc

SEQ ID NO: 7737 - DNA, 20 bp, Artificial
  20-mer unique DNA sequence
aatcggtggtccgatcctgg

SEQ ID NO: 7738 - DNA, 20 bp, Artificial
  20-mer unique DNA sequence
gggaccaagcggggagaaaa

SEQ ID NO: 7739 - DNA, 20 bp, Artificial
  20-mer unique DNA sequence
ccaagccggcagcgaatcag

SEQ ID NO: 7740 - DNA, 20 bp, Artificial
  20-mer unique DNA sequence
tccctccggctccatccttt

SEQ ID NO: 7741 - DNA, 20 bp, Artificial
  20-mer unique DNA sequence
ccgtgctctgcctcgtttcg

SEQ ID NO: 7742 - DNA, 20 bp, Artificial
  20-mer unique DNA sequence
gtggcgccggtttcttgtca

SEQ ID NO: 7743 - DNA, 20 bp, Artificial
  20-mer unique DNA sequence
aaccggcgccctcctactgc

SEQ ID NO: 7744 - DNA, 20 bp, Artificial
  20-mer unique DNA sequence
atgggcgttgtcggatgttg

SEQ ID NO: 7745 - DNA, 20 bp, Artificial
  20-mer unique DNA sequence
tgagttattggccgccggtt

SEQ ID NO: 7746 - DNA, 20 bp, Artificial
  20-mer unique DNA sequence
tggtactaggtcgaacggcg

SEQ ID NO: 7747 - DNA, 20 bp, Artificial
  20-mer unique DNA sequence
ttgagcgcatagactgccga

SEQ ID NO: 7748 - DNA, 20 bp, Artificial
  20-mer unique DNA sequence
ctggccgcaaccgcaaatac

SEQ ID NO: 7749 - DNA, 20 bp, Artificial
  20-mer unique DNA sequence
cacgtctgcgcggtctcaca

SEQ ID NO: 7750 - DNA, 20 bp, Artificial
  20-mer unique DNA sequence
cagccagcctccatcacgtg

SEQ ID NO: 7751 - DNA, 20 bp, Artificial
  20-mer unique DNA sequence
tgctttcattgctgcgggtt

SEQ ID NO: 7752 - DNA, 20 bp, Artificial
  20-mer unique DNA sequence
ctattccctcgccccccctt

SEQ ID NO: 7753 - DNA, 20 bp, Artificial
  20-mer unique DNA sequence
taggtggcagggaaggcgag

SEQ ID NO: 7754 - DNA, 20 bp, Artificial
  20-mer unique DNA sequence
accacaattcacctgcgggg

SEQ ID NO: 7755 - DNA, 20 bp, Artificial
  20-mer unique DNA sequence
ccaagattcgcggttcgcct

SEQ ID NO: 7756 - DNA, 20 bp, Artificial
  20-mer unique DNA sequence
gacaacgcccccctaaacgg

SEQ ID NO: 7757 - DNA, 20 bp, Artificial
  20-mer unique DNA sequence
cgccaaccgctcatcacctc

SEQ ID NO: 7758 - DNA, 20 bp, Artificial
  20-mer unique DNA sequence
ctctgcttgcgcggttgaac

SEQ ID NO: 7759 - DNA, 20 bp, Artificial
  20-mer unique DNA sequence
tggccttcacatcgccgcta

SEQ ID NO: 7760 - DNA, 20 bp, Artificial
  20-mer unique DNA sequence
cgttgcgcggtcagtttcat

SEQ ID NO: 7761 - DNA, 20 bp, Artificial
  20-mer unique DNA sequence
cgcaataagcagtggggcaa

SEQ ID NO: 7762 - DNA, 20 bp, Artificial
  20-mer unique DNA sequence
caaaacacccggacgcgaag

SEQ ID NO: 7763 - DNA, 20 bp, Artificial
  20-mer unique DNA sequence
tgggggttcgggagaggagt

SEQ ID NO: 7764 - DNA, 20 bp, Artificial
  20-mer unique DNA sequence
cagggtttcaggtttgcgcg

SEQ ID NO: 7765 - DNA, 20 bp, Artificial
  20-mer unique DNA sequence
ttgttacccccgccgacgtc

SEQ ID NO: 7766 - DNA, 20 bp, Artificial
  20-mer unique DNA sequence
tagggggccatgtgtgggac

SEQ ID NO: 7767 - DNA, 20 bp, Artificial
  20-mer unique DNA sequence
tcattggcagcaacgtgggt

SEQ ID NO: 7768 - DNA, 20 bp, Artificial
  20-mer unique DNA sequence
gtcaggcacgcaggaaaggc

SEQ ID NO: 7769 - DNA, 20 bp, Artificial
  20-mer unique DNA sequence
tggggcgcgcttaggatttc

SEQ ID NO: 7770 - DNA, 20 bp, Artificial
  20-mer unique DNA sequence
gcttccccaccatgtacgca

SEQ ID NO: 7771 - DNA, 20 bp, Artificial
  20-mer unique DNA sequence
cgcaaccgcaacaatcgcta

SEQ ID NO: 7772 - DNA, 20 bp, Artificial
  20-mer unique DNA sequence
cctctccgttggaccgaaca

SEQ ID NO: 7773 - DNA, 20 bp, Artificial
  20-mer unique DNA sequence
cggcatatcgcgctggacta

SEQ ID NO: 7774 - DNA, 20 bp, Artificial
  20-mer unique DNA sequence
ccccctccgttaatccagca

SEQ ID NO: 7775 - DNA, 20 bp, Artificial
  20-mer unique DNA sequence
cgccgacatgcccgtacttg

SEQ ID NO: 7776 - DNA, 20 bp, Artificial
  20-mer unique DNA sequence
acccccctgactgacacccc

SEQ ID NO: 7777 - DNA, 20 bp, Artificial
  20-mer unique DNA sequence
agtggtctgacacgcgtcct

SEQ ID NO: 7778 - DNA, 20 bp, Artificial
  20-mer unique DNA sequence
cccattccgaccgtccatcg

SEQ ID NO: 7779 - DNA, 20 bp, Artificial
  20-mer unique DNA sequence
ctcaggtgttggggaagcgg

SEQ ID NO: 7780 - DNA, 20 bp, Artificial
  20-mer unique DNA sequence
ttctctgcaaggcctcccag

SEQ ID NO: 7781 - DNA, 20 bp, Artificial
  20-mer unique DNA sequence
aagcgaggggggagggttca

SEQ ID NO: 7782 - DNA, 20 bp, Artificial
  20-mer unique DNA sequence
aaacgcggcctccctaacca

SEQ ID NO: 7783 - DNA, 20 bp, Artificial
  20-mer unique DNA sequence
ggttcttgcatgttcccggg

SEQ ID NO: 7784 - DNA, 20 bp, Artificial
  20-mer unique DNA sequence
acgagagggaaggcgaaaaa

SEQ ID NO: 7785 - DNA, 20 bp, Artificial
  20-mer unique DNA sequence
cggctcccgtctggctgtta

SEQ ID NO: 7786 - DNA, 20 bp, Artificial
  20-mer unique DNA sequence
gtctcctcgcccccacccaa

SEQ ID NO: 7787 - DNA, 20 bp, Artificial
  20-mer unique DNA sequence
tccattgcgcggtcactttg

SEQ ID NO: 7788 - DNA, 20 bp, Artificial
  20-mer unique DNA sequence
agcacaatactccccgccga

SEQ ID NO: 7789 - DNA, 20 bp, Artificial
  20-mer unique DNA sequence
gtacggccaacgcaaagggt

SEQ ID NO: 7790 - DNA, 20 bp, Artificial
  20-mer unique DNA sequence
cgggcgaatgttgggatgag

SEQ ID NO: 7791 - DNA, 20 bp, Artificial
  20-mer unique DNA sequence
cacacaagcgctgcatcccc

SEQ ID NO: 7792 - DNA, 20 bp, Artificial
  20-mer unique DNA sequence
tggaaatctgggggtggact

SEQ ID NO: 7793 - DNA, 20 bp, Artificial
  20-mer unique DNA sequence
taacccccgcaccactgctt

SEQ ID NO: 7794 - DNA, 20 bp, Artificial
  20-mer unique DNA sequence
atccgtcctacccgccacca

SEQ ID NO: 7795 - DNA, 20 bp, Artificial
  20-mer unique DNA sequence
tgccttttggcgggcttatc

SEQ ID NO: 7796 - DNA, 20 bp, Artificial
  20-mer unique DNA sequence
aagcgcaaggtaccggaggc

SEQ ID NO: 7797 - DNA, 20 bp, Artificial
  20-mer unique DNA sequence
cggggtgggtaatggttcga

SEQ ID NO: 7798 - DNA, 20 bp, Artificial
  20-mer unique DNA sequence
agagtggaagcagggtcggc

SEQ ID NO: 7799 - DNA, 20 bp, Artificial
  20-mer unique DNA sequence
cctcagcaaagcgtcccacc

SEQ ID NO: 7800 - DNA, 20 bp, Artificial
  20-mer unique DNA sequence
gtgcgggatctactggggca

SEQ ID NO: 7801 - DNA, 20 bp, Artificial
  20-mer unique DNA sequence
accgcttggcatctggggat

SEQ ID NO: 7802 - DNA, 20 bp, Artificial
  20-mer unique DNA sequence
gaaaccgatgctgcccctcc

SEQ ID NO: 7803 - DNA, 20 bp, Artificial
  20-mer unique DNA sequence
ctccccccgcatgacgatta

SEQ ID NO: 7804 - DNA, 20 bp, Artificial
  20-mer unique DNA sequence
gtggcgcctgggggtatcga

SEQ ID NO: 7805 - DNA, 20 bp, Artificial
  20-mer unique DNA sequence
aacgtgcgaccgactgtcca

SEQ ID NO: 7806 - DNA, 20 bp, Artificial
  20-mer unique DNA sequence
gttacaggacgggcgagggg

SEQ ID NO: 7807 - DNA, 20 bp, Artificial
  20-mer unique DNA sequence
ccttgggtttgttagcgcgc

SEQ ID NO: 7808 - DNA, 20 bp, Artificial
  20-mer unique DNA sequence
tggctggcgttttttggtcg

SEQ ID NO: 7809 - DNA, 20 bp, Artificial
  20-mer unique DNA sequence
gggggggtatttttccagcg

SEQ ID NO: 7810 - DNA, 20 bp, Artificial
  20-mer unique DNA sequence
ccatcctccccctctgcctg

SEQ ID NO: 7811 - DNA, 20 bp, Artificial
  20-mer unique DNA sequence
tattatgcccccacgacccc

SEQ ID NO: 7812 - DNA, 20 bp, Artificial
  20-mer unique DNA sequence
gggtgatgagagcgggcgtg

SEQ ID NO: 7813 - DNA, 20 bp, Artificial
  20-mer unique DNA sequence
gagggggggtgtatttggcg

SEQ ID NO: 7814 - DNA, 20 bp, Artificial
  20-mer unique DNA sequence
gcggcgatggtggcaagtta

SEQ ID NO: 7815 - DNA, 20 bp, Artificial
  20-mer unique DNA sequence
ggagaggtgtttgcgccgga

SEQ ID NO: 7816 - DNA, 20 bp, Artificial
  20-mer unique DNA sequence
cgcacgtcgggtaggtttgg

SEQ ID NO: 7817 - DNA, 20 bp, Artificial
  20-mer unique DNA sequence
gctcgggcgatccacatacg

SEQ ID NO: 7818 - DNA, 20 bp, Artificial
  20-mer unique DNA sequence
gcgtctcttgtccggggtgg

SEQ ID NO: 7819 - DNA, 20 bp, Artificial
  20-mer unique DNA sequence
agtcgtgcctagcgtctggt

SEQ ID NO: 7820 - DNA, 20 bp, Artificial
  20-mer unique DNA sequence
gctgaatatggggggtgcgg

SEQ ID NO: 7821 - DNA, 20 bp, Artificial
  20-mer unique DNA sequence
ggtgtattcgaggaccgcca

SEQ ID NO: 7822 - DNA, 20 bp, Artificial
  20-mer unique DNA sequence
tcgccccctgttttactgcg

SEQ ID NO: 7823 - DNA, 20 bp, Artificial
  20-mer unique DNA sequence
tcaccaccccttatgccccc

SEQ ID NO: 7824 - DNA, 20 bp, Artificial
  20-mer unique DNA sequence
ttgggttgttcccgttccga

SEQ ID NO: 7825 - DNA, 20 bp, Artificial
  20-mer unique DNA sequence
tgggtcaagagggggtcgga

SEQ ID NO: 7826 - DNA, 20 bp, Artificial
  20-mer unique DNA sequence
acaggccggcaacgggatta

SEQ ID NO: 7827 - DNA, 20 bp, Artificial
  20-mer unique DNA sequence
atattgacccgccgaagcca

SEQ ID NO: 7828 - DNA, 20 bp, Artificial
  20-mer unique DNA sequence
gcggttcgtctctggttgcc

SEQ ID NO: 7829 - DNA, 20 bp, Artificial
  20-mer unique DNA sequence
agcgcaacaactccgtccct

SEQ ID NO: 7830 - DNA, 20 bp, Artificial
  20-mer unique DNA sequence
gcacaggggaacgcattaca

SEQ ID NO: 7831 - DNA, 20 bp, Artificial
  20-mer unique DNA sequence
catcgataagcccccccccc

SEQ ID NO: 7832 - DNA, 20 bp, Artificial
  20-mer unique DNA sequence
tgctcggccgtcgcttataa

SEQ ID NO: 7833 - DNA, 20 bp, Artificial
  20-mer unique DNA sequence
cccaaagatctcccaacgcg

SEQ ID NO: 7834 - DNA, 20 bp, Artificial
  20-mer unique DNA sequence
cctttttcggccgcattgac

SEQ ID NO: 7835 - DNA, 20 bp, Artificial
  20-mer unique DNA sequence
acatttcgctggggggctcg

SEQ ID NO: 7836 - DNA, 20 bp, Artificial
  20-mer unique DNA sequence
ctcctcgcctgcaaaacccg

SEQ ID NO: 7837 - DNA, 20 bp, Artificial
  20-mer unique DNA sequence
ttggcgggaagtgcggagtg

SEQ ID NO: 7838 - DNA, 20 bp, Artificial
  20-mer unique DNA sequence
tttgccaccacacccactcg

SEQ ID NO: 7839 - DNA, 20 bp, Artificial
  20-mer unique DNA sequence
cgggggccaggtgagaaaac

SEQ ID NO: 7840 - DNA, 20 bp, Artificial
  20-mer unique DNA sequence
tcggaggcgtacaccgggag

SEQ ID NO: 7841 - DNA, 20 bp, Artificial
  20-mer unique DNA sequence
ccatgttgaaacccccgctc

SEQ ID NO: 7842 - DNA, 20 bp, Artificial
  20-mer unique DNA sequence
tggccggcatctctgttcgt

SEQ ID NO: 7843 - DNA, 20 bp, Artificial
  20-mer unique DNA sequence
agcgtttacccccagatccg

SEQ ID NO: 7844 - DNA, 20 bp, Artificial
  20-mer unique DNA sequence
cagccccccctaccttggaa

SEQ ID NO: 7845 - DNA, 20 bp, Artificial
  20-mer unique DNA sequence
ggtcggtcgctgggcttaac

SEQ ID NO: 7846 - DNA, 20 bp, Artificial
  20-mer unique DNA sequence
ggggaggagcaacggaggaa

SEQ ID NO: 7847 - DNA, 20 bp, Artificial
  20-mer unique DNA sequence
tcgaacagccgccaccatag

SEQ ID NO: 7848 - DNA, 20 bp, Artificial
  20-mer unique DNA sequence
ccgtgtcgtgtgccgactta

SEQ ID NO: 7849 - DNA, 20 bp, Artificial
  20-mer unique DNA sequence
gggctgcggtacgtggattg

SEQ ID NO: 7850 - DNA, 20 bp, Artificial
  20-mer unique DNA sequence
atcttggctttgcgcggttg

SEQ ID NO: 7851 - DNA, 20 bp, Artificial
  20-mer unique DNA sequence
accatcaagccgacccccaa

SEQ ID NO: 7852 - DNA, 20 bp, Artificial
  20-mer unique DNA sequence
gcacccctccaccgaccata

SEQ ID NO: 7853 - DNA, 20 bp, Artificial
  20-mer unique DNA sequence
tgtggcggaaagaacggctg

SEQ ID NO: 7854 - DNA, 20 bp, Artificial
  20-mer unique DNA sequence
aataccccgttgcgctgtcc

SEQ ID NO: 7855 - DNA, 20 bp, Artificial
  20-mer unique DNA sequence
agactacaggaggcgcggca

SEQ ID NO: 7856 - DNA, 20 bp, Artificial
  20-mer unique DNA sequence
gatgactgggacgggtggga

SEQ ID NO: 7857 - DNA, 20 bp, Artificial
  20-mer unique DNA sequence
cggttatgcgtgtggcgtgg

SEQ ID NO: 7858 - DNA, 20 bp, Artificial
  20-mer unique DNA sequence
ttggtgcctgccttccgttc

SEQ ID NO: 7859 - DNA, 20 bp, Artificial
  20-mer unique DNA sequence
tttctttcgcgcaacgtccg

SEQ ID NO: 7860 - DNA, 20 bp, Artificial
  20-mer unique DNA sequence
ccggttccccactccctgtt

SEQ ID NO: 7861 - DNA, 20 bp, Artificial
  20-mer unique DNA sequence
gtgggtgggggtgcagttga

SEQ ID NO: 7862 - DNA, 20 bp, Artificial
  20-mer unique DNA sequence
gcaagctgtcccccagaaag

SEQ ID NO: 7863 - DNA, 20 bp, Artificial
  20-mer unique DNA sequence
ctgttttccgcgctccgacc

SEQ ID NO: 7864 - DNA, 20 bp, Artificial
  20-mer unique DNA sequence
ctccacacagcgaagcccca

SEQ ID NO: 7865 - DNA, 20 bp, Artificial
  20-mer unique DNA sequence
gggcatccgggagttgatct

SEQ ID NO: 7866 - DNA, 20 bp, Artificial
  20-mer unique DNA sequence
catccccgccctggttttta

SEQ ID NO: 7867 - DNA, 20 bp, Artificial
  20-mer unique DNA sequence
gcgtgggggacggagttgtg

SEQ ID NO: 7868 - DNA, 20 bp, Artificial
  20-mer unique DNA sequence
tggacgctaggccgagttct

SEQ ID NO: 7869 - DNA, 20 bp, Artificial
  20-mer unique DNA sequence
gcaggagtcgcactggagtt

SEQ ID NO: 7870 - DNA, 20 bp, Artificial
  20-mer unique DNA sequence
ccggcgtggttgtgtcatgt

SEQ ID NO: 7871 - DNA, 20 bp, Artificial
  20-mer unique DNA sequence
atctccaccgtctctgcccg

SEQ ID NO: 7872 - DNA, 20 bp, Artificial
  20-mer unique DNA sequence
accccgtcactgatcccaac

SEQ ID NO: 7873 - DNA, 20 bp, Artificial
  20-mer unique DNA sequence
ttaatctgtgccatgcccgc

SEQ ID NO: 7874 - DNA, 20 bp, Artificial
  20-mer unique DNA sequence
catccggaccaccccaacct

SEQ ID NO: 7875 - DNA, 20 bp, Artificial
  20-mer unique DNA sequence
cggcttggacatggttgggt

SEQ ID NO: 7876 - DNA, 20 bp, Artificial
  20-mer unique DNA sequence
agatgatgttggcgtccccc

SEQ ID NO: 7877 - DNA, 20 bp, Artificial
  20-mer unique DNA sequence
accggggaggggtctttttc

SEQ ID NO: 7878 - DNA, 20 bp, Artificial
  20-mer unique DNA sequence
agactgatttgcggcagggc

SEQ ID NO: 7879 - DNA, 20 bp, Artificial
  20-mer unique DNA sequence
atcatttgggttgtcggggc

SEQ ID NO: 7880 - DNA, 20 bp, Artificial
  20-mer unique DNA sequence
ggctagcacgtaacccgtca

SEQ ID NO: 7881 - DNA, 20 bp, Artificial
  20-mer unique DNA sequence
gtcgccaggacgtgctaaga

SEQ ID NO: 7882 - DNA, 20 bp, Artificial
  20-mer unique DNA sequence
tctgcggaaccgtgtggcat

SEQ ID NO: 7883 - DNA, 20 bp, Artificial
  20-mer unique DNA sequence
cttgtcgctgccgtccctgg

SEQ ID NO: 7884 - DNA, 20 bp, Artificial
  20-mer unique DNA sequence
cccacgcgcaatagcatcat

SEQ ID NO: 7885 - DNA, 20 bp, Artificial
  20-mer unique DNA sequence
tcggcgtgtctttgagcggg

SEQ ID NO: 7886 - DNA, 20 bp, Artificial
  20-mer unique DNA sequence
tggctcgggtctttacggga

SEQ ID NO: 7887 - DNA, 20 bp, Artificial
  20-mer unique DNA sequence
tggtcaatgggagtggctgc

SEQ ID NO: 7888 - DNA, 20 bp, Artificial
  20-mer unique DNA sequence
tcaatatgccctccccaccc

SEQ ID NO: 7889 - DNA, 20 bp, Artificial
  20-mer unique DNA sequence
acctccgcctgtcccctcat

SEQ ID NO: 7890 - DNA, 20 bp, Artificial
  20-mer unique DNA sequence
attgctccggcgccagtttt

SEQ ID NO: 7891 - DNA, 20 bp, Artificial
  20-mer unique DNA sequence
acgcaacaagtccccaagcc

SEQ ID NO: 7892 - DNA, 20 bp, Artificial
  20-mer unique DNA sequence
ggtcatttcgcaggtgatca

SEQ ID NO: 7893 - DNA, 20 bp, Artificial
  20-mer unique DNA sequence
ggtgcggccgagaaacaatg

SEQ ID NO: 7894 - DNA, 20 bp, Artificial
  20-mer unique DNA sequence
agatggcgttgcgttcggtt

SEQ ID NO: 7895 - DNA, 20 bp, Artificial
  20-mer unique DNA sequence
gccactcaccggaccaacga

SEQ ID NO: 7896 - DNA, 20 bp, Artificial
  20-mer unique DNA sequence
atatgtttggacgcggtgcg

SEQ ID NO: 7897 - DNA, 20 bp, Artificial
  20-mer unique DNA sequence
agtccaggagacggcgctcg

SEQ ID NO: 7898 - DNA, 20 bp, Artificial
  20-mer unique DNA sequence
cgaatgggggcgagcagtac

SEQ ID NO: 7899 - DNA, 20 bp, Artificial
  20-mer unique DNA sequence
ttgatcggccgttgtttcca

SEQ ID NO: 7900 - DNA, 20 bp, Artificial
  20-mer unique DNA sequence
gtgggggggctatctctgcg

SEQ ID NO: 7901 - DNA, 20 bp, Artificial
  20-mer unique DNA sequence
cgctccgcccacgaatacca

SEQ ID NO: 7902 - DNA, 20 bp, Artificial
  20-mer unique DNA sequence
tccggaatgggcgactacgt

SEQ ID NO: 7903 - DNA, 20 bp, Artificial
  20-mer unique DNA sequence
atatggcttcggcagggggc

SEQ ID NO: 7904 - DNA, 20 bp, Artificial
  20-mer unique DNA sequence
cgaactcaaaaaggggcgct

SEQ ID NO: 7905 - DNA, 20 bp, Artificial
  20-mer unique DNA sequence
catgaggcagaggacggacc

SEQ ID NO: 7906 - DNA, 20 bp, Artificial
  20-mer unique DNA sequence
tttcctcgacccccctccat

SEQ ID NO: 7907 - DNA, 20 bp, Artificial
  20-mer unique DNA sequence
tcagcatgtttgggtggcag

SEQ ID NO: 7908 - DNA, 20 bp, Artificial
  20-mer unique DNA sequence
gcgaagcaggagggttttgg

SEQ ID NO: 7909 - DNA, 20 bp, Artificial
  20-mer unique DNA sequence
tcaaccgcatctcgccccct

SEQ ID NO: 7910 - DNA, 20 bp, Artificial
  20-mer unique DNA sequence
caccatcgatccctccccaa

SEQ ID NO: 7911 - DNA, 20 bp, Artificial
  20-mer unique DNA sequence
tgcaatgggttaggtggggc

SEQ ID NO: 7912 - DNA, 20 bp, Artificial
  20-mer unique DNA sequence
acatggagtgtccagtggcg

SEQ ID NO: 7913 - DNA, 20 bp, Artificial
  20-mer unique DNA sequence
ggggcaaccggaaagagctg

SEQ ID NO: 7914 - DNA, 20 bp, Artificial
  20-mer unique DNA sequence
caccacacgttcccctccgg

SEQ ID NO: 7915 - DNA, 20 bp, Artificial
  20-mer unique DNA sequence
cgggaggtgcagtggtgtcg

SEQ ID NO: 7916 - DNA, 20 bp, Artificial
  20-mer unique DNA sequence
cgtgggacagggcaggtctg

SEQ ID NO: 7917 - DNA, 20 bp, Artificial
  20-mer unique DNA sequence
gaggagcggaccgaagtgcg

SEQ ID NO: 7918 - DNA, 20 bp, Artificial
  20-mer unique DNA sequence
accaggtaggcgtcggatga

SEQ ID NO: 7919 - DNA, 20 bp, Artificial
  20-mer unique DNA sequence
tagctgtgtcgcgtcgatga

SEQ ID NO: 7920 - DNA, 20 bp, Artificial
  20-mer unique DNA sequence
actcaaacgcgcgcaagtgg

SEQ ID NO: 7921 - DNA, 20 bp, Artificial
  20-mer unique DNA sequence
acccggcgcaccgtaagctc

SEQ ID NO: 7922 - DNA, 20 bp, Artificial
  20-mer unique DNA sequence
ataacggggcggatcggagg

SEQ ID NO: 7923 - DNA, 20 bp, Artificial
  20-mer unique DNA sequence
gcaacccgaacaggccacga

SEQ ID NO: 7924 - DNA, 20 bp, Artificial
  20-mer unique DNA sequence
aaaggaatgagtcgcgcccg

SEQ ID NO: 7925 - DNA, 20 bp, Artificial
  20-mer unique DNA sequence
acaggacggcctcacgcaag

SEQ ID NO: 7926 - DNA, 20 bp, Artificial
  20-mer unique DNA sequence
agcccatgaccaacgacccc

SEQ ID NO: 7927 - DNA, 20 bp, Artificial
  20-mer unique DNA sequence
ctgcggtccccgtgtcgatt

SEQ ID NO: 7928 - DNA, 20 bp, Artificial
  20-mer unique DNA sequence
tttctcgaccgctcctccgg

SEQ ID NO: 7929 - DNA, 20 bp, Artificial
  20-mer unique DNA sequence
acctgcggttacgcgaacta

SEQ ID NO: 7930 - DNA, 20 bp, Artificial
  20-mer unique DNA sequence
tgaacgatccccccctccat

SEQ ID NO: 7931 - DNA, 20 bp, Artificial
  20-mer unique DNA sequence
acccgcgccgtgctacaata

SEQ ID NO: 7932 - DNA, 20 bp, Artificial
  20-mer unique DNA sequence
tgtactcgcccctccacggg

SEQ ID NO: 7933 - DNA, 20 bp, Artificial
  20-mer unique DNA sequence
cccagcgatgagttgcgacc

SEQ ID NO: 7934 - DNA, 20 bp, Artificial
  20-mer unique DNA sequence
aacccacgcggcacttgaac

SEQ ID NO: 7935 - DNA, 20 bp, Artificial
  20-mer unique DNA sequence
ttagcaccgccctgacccgt

SEQ ID NO: 7936 - DNA, 20 bp, Artificial
  20-mer unique DNA sequence
acgagacgggcagcggtaga

SEQ ID NO: 7937 - DNA, 20 bp, Artificial
  20-mer unique DNA sequence
tgttggtcgccttgtcggtg

SEQ ID NO: 7938 - DNA, 20 bp, Artificial
  20-mer unique DNA sequence
tgccgcttcttctcttcgca

SEQ ID NO: 7939 - DNA, 20 bp, Artificial
  20-mer unique DNA sequence
atggcaccctcctggcgaat

SEQ ID NO: 7940 - DNA, 20 bp, Artificial
  20-mer unique DNA sequence
tcgcgcgcgctctcactaaa

SEQ ID NO: 7941 - DNA, 20 bp, Artificial
  20-mer unique DNA sequence
accattaggcggcaacccac

SEQ ID NO: 7942 - DNA, 20 bp, Artificial
  20-mer unique DNA sequence
cactttccgatatccgcgcg

SEQ ID NO: 7943 - DNA, 20 bp, Artificial
  20-mer unique DNA sequence
aagagcccaatgccccgacg

SEQ ID NO: 7944 - DNA, 20 bp, Artificial
  20-mer unique DNA sequence
ccgtgcaggggaatatggcg

SEQ ID NO: 7945 - DNA, 20 bp, Artificial
  20-mer unique DNA sequence
cctgctcgaaatgctccgtg

SEQ ID NO: 7946 - DNA, 20 bp, Artificial
  20-mer unique DNA sequence
gggagggccggagaagacca

SEQ ID NO: 7947 - DNA, 20 bp, Artificial
  20-mer unique DNA sequence
gctggggacttcgtgggtac

SEQ ID NO: 7948 - DNA, 20 bp, Artificial
  20-mer unique DNA sequence
ggggcgcctcaaaaccaaca

SEQ ID NO: 7949 - DNA, 20 bp, Artificial
  20-mer unique DNA sequence
tcgcagtccgcttcacagtg

SEQ ID NO: 7950 - DNA, 20 bp, Artificial
  20-mer unique DNA sequence
gttcgtggttggggcatgcg

SEQ ID NO: 7951 - DNA, 20 bp, Artificial
  20-mer unique DNA sequence
atgcccgcccactcaaactg

SEQ ID NO: 7952 - DNA, 20 bp, Artificial
  20-mer unique DNA sequence
aagggcacgggattgggctc

SEQ ID NO: 7953 - DNA, 20 bp, Artificial
  20-mer unique DNA sequence
tacggaaaagcatggggcct

SEQ ID NO: 7954 - DNA, 20 bp, Artificial
  20-mer unique DNA sequence
acaaggcgtggctggggaac

SEQ ID NO: 7955 - DNA, 20 bp, Artificial
  20-mer unique DNA sequence
gccttgcgtggggcagttct

SEQ ID NO: 7956 - DNA, 20 bp, Artificial
  20-mer unique DNA sequence
aatttcgccctccccagtga

SEQ ID NO: 7957 - DNA, 20 bp, Artificial
  20-mer unique DNA sequence
tcgtcccgctcttgcctctg

SEQ ID NO: 7958 - DNA, 20 bp, Artificial
  20-mer unique DNA sequence
tggggggcgtggagttaggc

SEQ ID NO: 7959 - DNA, 20 bp, Artificial
  20-mer unique DNA sequence
ccagccggatgtgcactttg

SEQ ID NO: 7960 - DNA, 20 bp, Artificial
  20-mer unique DNA sequence
gttccgggtgcgctccttta

SEQ ID NO: 7961 - DNA, 20 bp, Artificial
  20-mer unique DNA sequence
cccgagatcaccagacgccc

SEQ ID NO: 7962 - DNA, 20 bp, Artificial
  20-mer unique DNA sequence
cctggtgcctttccttgccg

SEQ ID NO: 7963 - DNA, 20 bp, Artificial
  20-mer unique DNA sequence
tccttcggcagcggtctttt

SEQ ID NO: 7964 - DNA, 20 bp, Artificial
  20-mer unique DNA sequence
gcagcccgtcagcttcgttg

SEQ ID NO: 7965 - DNA, 20 bp, Artificial
  20-mer unique DNA sequence
cttgaacgccctagccccca

SEQ ID NO: 7966 - DNA, 20 bp, Artificial
  20-mer unique DNA sequence
ttggtcgagggcggagggta

SEQ ID NO: 7967 - DNA, 20 bp, Artificial
  20-mer unique DNA sequence
ccatgagcgacggcttttga

SEQ ID NO: 7968 - DNA, 20 bp, Artificial
  20-mer unique DNA sequence
cacgaaatgccccaacccat

SEQ ID NO: 7969 - DNA, 20 bp, Artificial
  20-mer unique DNA sequence
tagcgatttggtgggggacc

SEQ ID NO: 7970 - DNA, 20 bp, Artificial
  20-mer unique DNA sequence
gggtgccacggcttgaagat

SEQ ID NO: 7971 - DNA, 20 bp, Artificial
  20-mer unique DNA sequence
gccgccctacgtcaaatgct

SEQ ID NO: 7972 - DNA, 20 bp, Artificial
  20-mer unique DNA sequence
aagtaacgcgcacgccaatg

SEQ ID NO: 7973 - DNA, 20 bp, Artificial
  20-mer unique DNA sequence
gaccccgttagttggcccga

SEQ ID NO: 7974 - DNA, 20 bp, Artificial
  20-mer unique DNA sequence
tggggaatgcgcggaactgt

SEQ ID NO: 7975 - DNA, 20 bp, Artificial
  20-mer unique DNA sequence
cacctttgtcggccgtctca

SEQ ID NO: 7976 - DNA, 20 bp, Artificial
  20-mer unique DNA sequence
caatggaaagcacaccgcgg

SEQ ID NO: 7977 - DNA, 20 bp, Artificial
  20-mer unique DNA sequence
tcgggcgcatggatttactg

SEQ ID NO: 7978 - DNA, 20 bp, Artificial
  20-mer unique DNA sequence
gtccgcttcgctcctgtccg

SEQ ID NO: 7979 - DNA, 20 bp, Artificial
  20-mer unique DNA sequence
gactctccgcgcaccaacag

SEQ ID NO: 7980 - DNA, 20 bp, Artificial
  20-mer unique DNA sequence
cattgacccaacaccacgcc

SEQ ID NO: 7981 - DNA, 20 bp, Artificial
  20-mer unique DNA sequence
ggggcttcggtgcgttcgta

SEQ ID NO: 7982 - DNA, 20 bp, Artificial
  20-mer unique DNA sequence
ggctgcgagctgaaaggggt

SEQ ID NO: 7983 - DNA, 20 bp, Artificial
  20-mer unique DNA sequence
catagcgcccctcccgagtc

SEQ ID NO: 7984 - DNA, 20 bp, Artificial
  20-mer unique DNA sequence
accctccacgaatccgcacc

SEQ ID NO: 7985 - DNA, 20 bp, Artificial
  20-mer unique DNA sequence
tcgggaggtagaggatgcgc

SEQ ID NO: 7986 - DNA, 20 bp, Artificial
  20-mer unique DNA sequence
cggccagatcggggggtata

SEQ ID NO: 7987 - DNA, 20 bp, Artificial
  20-mer unique DNA sequence
ccgaaacgcgtgaagtgcat

SEQ ID NO: 7988 - DNA, 20 bp, Artificial
  20-mer unique DNA sequence
ctcctccgccgcacgaaaag

SEQ ID NO: 7989 - DNA, 20 bp, Artificial
  20-mer unique DNA sequence
gattaaagcgcgccccgagt

SEQ ID NO: 7990 - DNA, 20 bp, Artificial
  20-mer unique DNA sequence
gatgggacggatgcctggat

SEQ ID NO: 7991 - DNA, 20 bp, Artificial
  20-mer unique DNA sequence
caagagactgcacggcgccc

SEQ ID NO: 7992 - DNA, 20 bp, Artificial
  20-mer unique DNA sequence
aggttgaatagcgccacggg

SEQ ID NO: 7993 - DNA, 20 bp, Artificial
  20-mer unique DNA sequence
cagaatgagagtcagcgcgg

SEQ ID NO: 7994 - DNA, 20 bp, Artificial
  20-mer unique DNA sequence
ttgcgtggggggacagaggt

SEQ ID NO: 7995 - DNA, 20 bp, Artificial
  20-mer unique DNA sequence
ctggcacagctttggacggc

SEQ ID NO: 7996 - DNA, 20 bp, Artificial
  20-mer unique DNA sequence
ccccggcccaagccattaat

SEQ ID NO: 7997 - DNA, 20 bp, Artificial
  20-mer unique DNA sequence
cgtgcggcctaccaaattcc

SEQ ID NO: 7998 - DNA, 20 bp, Artificial
  20-mer unique DNA sequence
ccttgggggtatgcgtttgg

SEQ ID NO: 7999 - DNA, 20 bp, Artificial
  20-mer unique DNA sequence
cgggagatcgaccacaacgg

SEQ ID NO: 8000 - DNA, 20 bp, Artificial
  20-mer unique DNA sequence
tctttaatcccagcgccggt

SEQ ID NO: 8001 - DNA, 20 bp, Artificial
  20-mer unique DNA sequence
tctttgtgcccctttccgcc

SEQ ID NO: 8002 - DNA, 20 bp, Artificial
  20-mer unique DNA sequence
aacatttgacgcgacgggct

SEQ ID NO: 8003 - DNA, 20 bp, Artificial
  20-mer unique DNA sequence
tcggaggaggccagaaaaca

SEQ ID NO: 8004 - DNA, 20 bp, Artificial
  20-mer unique DNA sequence
cggcgcccatgaaaagagtg

SEQ ID NO: 8005 - DNA, 20 bp, Artificial
  20-mer unique DNA sequence
gggggaatgcgcttggaata

SEQ ID NO: 8006 - DNA, 20 bp, Artificial
  20-mer unique DNA sequence
tatggggacgtgttcggggt

SEQ ID NO: 8007 - DNA, 20 bp, Artificial
  20-mer unique DNA sequence
catcaaacggcgggaaggga

SEQ ID NO: 8008 - DNA, 20 bp, Artificial
  20-mer unique DNA sequence
tcactagcgccggcccaaaa

SEQ ID NO: 8009 - DNA, 20 bp, Artificial
  20-mer unique DNA sequence
atgattccaaccccccctcg

SEQ ID NO: 8010 - DNA, 20 bp, Artificial
  20-mer unique DNA sequence
cagccgagcgccgaattaga

SEQ ID NO: 8011 - DNA, 20 bp, Artificial
  20-mer unique DNA sequence
caccactccacgcattccgc

SEQ ID NO: 8012 - DNA, 20 bp, Artificial
  20-mer unique DNA sequence
aaccccgcctgtcttacccc

SEQ ID NO: 8013 - DNA, 20 bp, Artificial
  20-mer unique DNA sequence
aagggcagacaggcgggaca

SEQ ID NO: 8014 - DNA, 20 bp, Artificial
  20-mer unique DNA sequence
attggcgacgggtcttcagg

SEQ ID NO: 8015 - DNA, 20 bp, Artificial
  20-mer unique DNA sequence
tccgcccgtcgcaaagaatg

SEQ ID NO: 8016 - DNA, 20 bp, Artificial
  20-mer unique DNA sequence
agagatcccgcctgccaaca

SEQ ID NO: 8017 - DNA, 20 bp, Artificial
  20-mer unique DNA sequence
tccgccacgtccacctgaga

SEQ ID NO: 8018 - DNA, 20 bp, Artificial
  20-mer unique DNA sequence
ctgggtgaaacggctgctcc

SEQ ID NO: 8019 - DNA, 20 bp, Artificial
  20-mer unique DNA sequence
gggtaaatgcgccggtacgg

SEQ ID NO: 8020 - DNA, 20 bp, Artificial
  20-mer unique DNA sequence
tggcgtctcccctgttgtgg

SEQ ID NO: 8021 - DNA, 20 bp, Artificial
  20-mer unique DNA sequence
tggcagatgggggcgtggta

SEQ ID NO: 8022 - DNA, 20 bp, Artificial
  20-mer unique DNA sequence
gcctccactgtctccgcgat

SEQ ID NO: 8023 - DNA, 20 bp, Artificial
  20-mer unique DNA sequence
taggacggggctttatcgcg

SEQ ID NO: 8024 - DNA, 20 bp, Artificial
  20-mer unique DNA sequence
aatggatgtttgacgcggcg

SEQ ID NO: 8025 - DNA, 20 bp, Artificial
  20-mer unique DNA sequence
gtggacggcgaggtgtggct

SEQ ID NO: 8026 - DNA, 20 bp, Artificial
  20-mer unique DNA sequence
tgatgtctacagggcggcgc

SEQ ID NO: 8027 - DNA, 20 bp, Artificial
  20-mer unique DNA sequence
acgtgcgctaagcgagtacc

SEQ ID NO: 8028 - DNA, 20 bp, Artificial
  20-mer unique DNA sequence
cggtgcgggcgtctcataca

SEQ ID NO: 8029 - DNA, 20 bp, Artificial
  20-mer unique DNA sequence
aaacccccgtaaggcaagca

SEQ ID NO: 8030 - DNA, 20 bp, Artificial
  20-mer unique DNA sequence
gggccgcaggatcaagaatg

SEQ ID NO: 8031 - DNA, 20 bp, Artificial
  20-mer unique DNA sequence
aagtggcggggggttgagag

SEQ ID NO: 8032 - DNA, 20 bp, Artificial
  20-mer unique DNA sequence
gtgggccaaggggcgatgta

SEQ ID NO: 8033 - DNA, 20 bp, Artificial
  20-mer unique DNA sequence
agttccgctcacgctccctg

SEQ ID NO: 8034 - DNA, 20 bp, Artificial
  20-mer unique DNA sequence
gccttgtcactgcccgatcc

SEQ ID NO: 8035 - DNA, 20 bp, Artificial
  20-mer unique DNA sequence
ggtcgatgttgggtcaggca

SEQ ID NO: 8036 - DNA, 20 bp, Artificial
  20-mer unique DNA sequence
ttgcccggatataggcagcg

SEQ ID NO: 8037 - DNA, 20 bp, Artificial
  20-mer unique DNA sequence
attatgcggaccacgggacg

SEQ ID NO: 8038 - DNA, 20 bp, Artificial
  20-mer unique DNA sequence
tcaacggcaggaaaggggga

SEQ ID NO: 8039 - DNA, 20 bp, Artificial
  20-mer unique DNA sequence
ccggttattggcgtgctgga

SEQ ID NO: 8040 - DNA, 20 bp, Artificial
  20-mer unique DNA sequence
gatttgggccgcgggatatt

SEQ ID NO: 8041 - DNA, 20 bp, Artificial
  20-mer unique DNA sequence
aaggtccgcgacagaggaac

SEQ ID NO: 8042 - DNA, 20 bp, Artificial
  20-mer unique DNA sequence
catggggcgtgcgaggaatc

SEQ ID NO: 8043 - DNA, 20 bp, Artificial
  20-mer unique DNA sequence
ccacacggcctcggacttca

SEQ ID NO: 8044 - DNA, 20 bp, Artificial
  20-mer unique DNA sequence
gagagaggcaaatcgggccg

SEQ ID NO: 8045 - DNA, 20 bp, Artificial
  20-mer unique DNA sequence
ggctcattgcttgtgcgacg

SEQ ID NO: 8046 - DNA, 20 bp, Artificial
  20-mer unique DNA sequence
ttcattatttcgggggggca

SEQ ID NO: 8047 - DNA, 20 bp, Artificial
  20-mer unique DNA sequence
aggaaacaacaagggcgggg

SEQ ID NO: 8048 - DNA, 20 bp, Artificial
  20-mer unique DNA sequence
acggaatgaaagggccacgg

SEQ ID NO: 8049 - DNA, 20 bp, Artificial
  20-mer unique DNA sequence
atacttatcggcaccgcggg

SEQ ID NO: 8050 - DNA, 20 bp, Artificial
  20-mer unique DNA sequence
atttggtgcaggacggtggc

SEQ ID NO: 8051 - DNA, 20 bp, Artificial
  20-mer unique DNA sequence
gttacagagccggaccccca

SEQ ID NO: 8052 - DNA, 20 bp, Artificial
  20-mer unique DNA sequence
ttcagtgcgttcggggctta

SEQ ID NO: 8053 - DNA, 20 bp, Artificial
  20-mer unique DNA sequence
aaaaagagtggcgcgaagcc

SEQ ID NO: 8054 - DNA, 20 bp, Artificial
  20-mer unique DNA sequence
ggggcggttctttgagttgc

SEQ ID NO: 8055 - DNA, 20 bp, Artificial
  20-mer unique DNA sequence
tgccccgtgtctcttcgttg

SEQ ID NO: 8056 - DNA, 20 bp, Artificial
  20-mer unique DNA sequence
aggacatcacggacacgcgg

SEQ ID NO: 8057 - DNA, 20 bp, Artificial
  20-mer unique DNA sequence
cgagccgagattgcctgcac

SEQ ID NO: 8058 - DNA, 20 bp, Artificial
  20-mer unique DNA sequence
gcagccactccctatccccg

SEQ ID NO: 8059 - DNA, 20 bp, Artificial
  20-mer unique DNA sequence
tcgggatcagccagtcgttg

SEQ ID NO: 8060 - DNA, 20 bp, Artificial
  20-mer unique DNA sequence
tgacctccgcgactgcaatt

SEQ ID NO: 8061 - DNA, 20 bp, Artificial
  20-mer unique DNA sequence
cgaacgaattgggccgaggt

SEQ ID NO: 8062 - DNA, 20 bp, Artificial
  20-mer unique DNA sequence
cggcaccgcggataattgtc

SEQ ID NO: 8063 - DNA, 20 bp, Artificial
  20-mer unique DNA sequence
gcgggccttgccatgacttt

SEQ ID NO: 8064 - DNA, 20 bp, Artificial
  20-mer unique DNA sequence
tgtttatcggcggggggcct

SEQ ID NO: 8065 - DNA, 20 bp, Artificial
  20-mer unique DNA sequence
atagcgcgaggtcacagggc

SEQ ID NO: 8066 - DNA, 20 bp, Artificial
  20-mer unique DNA sequence
agggcgggctggaggatgag

SEQ ID NO: 8067 - DNA, 20 bp, Artificial
  20-mer unique DNA sequence
ttctgccctttacccagccg

SEQ ID NO: 8068 - DNA, 20 bp, Artificial
  20-mer unique DNA sequence
actcttggccgatctgcgtg

SEQ ID NO: 8069 - DNA, 20 bp, Artificial
  20-mer unique DNA sequence
atctctcgggtagacggcca

SEQ ID NO: 8070 - DNA, 20 bp, Artificial
  20-mer unique DNA sequence
ggccctcttcatgcaatccg

SEQ ID NO: 8071 - DNA, 20 bp, Artificial
  20-mer unique DNA sequence
tacaggaggggaccggcgag

SEQ ID NO: 8072 - DNA, 20 bp, Artificial
  20-mer unique DNA sequence
ctgggctagtcgggcaaggg

SEQ ID NO: 8073 - DNA, 20 bp, Artificial
  20-mer unique DNA sequence
atgatccgccaaccagcacg

SEQ ID NO: 8074 - DNA, 20 bp, Artificial
  20-mer unique DNA sequence
cctattcggttcctctgccc

SEQ ID NO: 8075 - DNA, 20 bp, Artificial
  20-mer unique DNA sequence
gtttgccgctttcgcctgtg

SEQ ID NO: 8076 - DNA, 20 bp, Artificial
  20-mer unique DNA sequence
gcctgaccgcctacgccaaa

SEQ ID NO: 8077 - DNA, 20 bp, Artificial
  20-mer unique DNA sequence
ggcggggtgaggggagaatt

SEQ ID NO: 8078 - DNA, 20 bp, Artificial
  20-mer unique DNA sequence
gcgaaaggcgaaatagcggt

SEQ ID NO: 8079 - DNA, 20 bp, Artificial
  20-mer unique DNA sequence
agtgggggacggacggcaac

SEQ ID NO: 8080 - DNA, 20 bp, Artificial
  20-mer unique DNA sequence
aataccacacgaaccgcccg

SEQ ID NO: 8081 - DNA, 20 bp, Artificial
  20-mer unique DNA sequence
tctccccgcagccacacctt

SEQ ID NO: 8082 - DNA, 20 bp, Artificial
  20-mer unique DNA sequence
tgtggtatgaagcgcgggag

SEQ ID NO: 8083 - DNA, 20 bp, Artificial
  20-mer unique DNA sequence
gcaggcttatttttcgcggc

SEQ ID NO: 8084 - DNA, 20 bp, Artificial
  20-mer unique DNA sequence
cgccctgcaacgctcactcc

SEQ ID NO: 8085 - DNA, 20 bp, Artificial
  20-mer unique DNA sequence
tggatgggcgtgaacaggga

SEQ ID NO: 8086 - DNA, 20 bp, Artificial
  20-mer unique DNA sequence
tgcggcaacaggaacttgga

SEQ ID NO: 8087 - DNA, 20 bp, Artificial
  20-mer unique DNA sequence
tcggttgggaatcagggtgg

SEQ ID NO: 8088 - DNA, 20 bp, Artificial
  20-mer unique DNA sequence
cccgaacccccgatagatgg

SEQ ID NO: 8089 - DNA, 20 bp, Artificial
  20-mer unique DNA sequence
caacaagccctgcccgtgat

SEQ ID NO: 8090 - DNA, 20 bp, Artificial
  20-mer unique DNA sequence
ccggcaatcgggttccacta

SEQ ID NO: 8091 - DNA, 20 bp, Artificial
  20-mer unique DNA sequence
gccgacagttcacgcgacta

SEQ ID NO: 8092 - DNA, 20 bp, Artificial
  20-mer unique DNA sequence
gctcacgaactcgccaaaaa

SEQ ID NO: 8093 - DNA, 20 bp, Artificial
  20-mer unique DNA sequence
gaagtgatggacggcaggca

SEQ ID NO: 8094 - DNA, 20 bp, Artificial
  20-mer unique DNA sequence
tctatcggaatcgccacgcc

SEQ ID NO: 8095 - DNA, 20 bp, Artificial
  20-mer unique DNA sequence
caaaagcgactgcccccgaa

SEQ ID NO: 8096 - DNA, 20 bp, Artificial
  20-mer unique DNA sequence
cgacaggaggccggaaaagc

SEQ ID NO: 8097 - DNA, 20 bp, Artificial
  20-mer unique DNA sequence
aagcaacttccggcctcgca

SEQ ID NO: 8098 - DNA, 20 bp, Artificial
  20-mer unique DNA sequence
ggtggaggccgtgaattgca

SEQ ID NO: 8099 - DNA, 20 bp, Artificial
  20-mer unique DNA sequence
agctttttgatccatgcggg

SEQ ID NO: 8100 - DNA, 20 bp, Artificial
  20-mer unique DNA sequence
cacctctatgcgatccggcc

SEQ ID NO: 8101 - DNA, 20 bp, Artificial
  20-mer unique DNA sequence
cgccgcgttttgttcagctc

SEQ ID NO: 8102 - DNA, 20 bp, Artificial
  20-mer unique DNA sequence
gcgaagaaaatggcagggcg

SEQ ID NO: 8103 - DNA, 20 bp, Artificial
  20-mer unique DNA sequence
cttcctgaccgctcccaacg

SEQ ID NO: 8104 - DNA, 20 bp, Artificial
  20-mer unique DNA sequence
gccccgtagctgcgaaagag

SEQ ID NO: 8105 - DNA, 20 bp, Artificial
  20-mer unique DNA sequence
gcgcgggtaggtgcgtgtga

SEQ ID NO: 8106 - DNA, 20 bp, Artificial
  20-mer unique DNA sequence
cccccgtttccctcgcacta

SEQ ID NO: 8107 - DNA, 20 bp, Artificial
  20-mer unique DNA sequence
agcggggtgaggtacgaaag

SEQ ID NO: 8108 - DNA, 20 bp, Artificial
  20-mer unique DNA sequence
gcggatgctacgaattggcg

SEQ ID NO: 8109 - DNA, 20 bp, Artificial
  20-mer unique DNA sequence
gcttggccggaggggtacac

SEQ ID NO: 8110 - DNA, 20 bp, Artificial
  20-mer unique DNA sequence
aacgcttccggccctagacg

SEQ ID NO: 8111 - DNA, 20 bp, Artificial
  20-mer unique DNA sequence
cgacttccgcatctccccac

SEQ ID NO: 8112 - DNA, 20 bp, Artificial
  20-mer unique DNA sequence
gactctgcgcgctccatcgg

SEQ ID NO: 8113 - DNA, 20 bp, Artificial
  20-mer unique DNA sequence
tgggatctacggcccttggg

SEQ ID NO: 8114 - DNA, 20 bp, Artificial
  20-mer unique DNA sequence
ctcccgcaaccgatcagctg

SEQ ID NO: 8115 - DNA, 20 bp, Artificial
  20-mer unique DNA sequence
ttgttccattacggcgtcct

SEQ ID NO: 8116 - DNA, 20 bp, Artificial
  20-mer unique DNA sequence
ttagggcagcaggcggaggg

SEQ ID NO: 8117 - DNA, 20 bp, Artificial
  20-mer unique DNA sequence
gttcgggttccttgccttgc

SEQ ID NO: 8118 - DNA, 20 bp, Artificial
  20-mer unique DNA sequence
aacacaccgcccagccatcg

SEQ ID NO: 8119 - DNA, 20 bp, Artificial
  20-mer unique DNA sequence
aggttggggtcgactgtggc

SEQ ID NO: 8120 - DNA, 20 bp, Artificial
  20-mer unique DNA sequence
ggtttcggccgctaggtgtc

SEQ ID NO: 8121 - DNA, 20 bp, Artificial
  20-mer unique DNA sequence
tcgacccgcatatcccccag

SEQ ID NO: 8122 - DNA, 20 bp, Artificial
  20-mer unique DNA sequence
ggccaaaacaagcaccgcaa

SEQ ID NO: 8123 - DNA, 20 bp, Artificial
  20-mer unique DNA sequence
gaaaggcaggcgtgggcgat

SEQ ID NO: 8124 - DNA, 20 bp, Artificial
  20-mer unique DNA sequence
ccaatctgtgctctccgcga

SEQ ID NO: 8125 - DNA, 20 bp, Artificial
  20-mer unique DNA sequence
cgtcggccaggtttgcaagg

SEQ ID NO: 8126 - DNA, 20 bp, Artificial
  20-mer unique DNA sequence
ggcggtaagattggcgaagc

SEQ ID NO: 8127 - DNA, 20 bp, Artificial
  20-mer unique DNA sequence
gtggggcaatcggcaaaaag

SEQ ID NO: 8128 - DNA, 20 bp, Artificial
  20-mer unique DNA sequence
acacccggcattcacccacg

SEQ ID NO: 8129 - DNA, 20 bp, Artificial
  20-mer unique DNA sequence
gtttgggttggagtgcgtct

SEQ ID NO: 8130 - DNA, 20 bp, Artificial
  20-mer unique DNA sequence
gcgccctcgtttggtacccc

SEQ ID NO: 8131 - DNA, 20 bp, Artificial
  20-mer unique DNA sequence
tgatcgtatttgcagggcgc

SEQ ID NO: 8132 - DNA, 20 bp, Artificial
  20-mer unique DNA sequence
ggcgagggaagggttgtgtg

SEQ ID NO: 8133 - DNA, 20 bp, Artificial
  20-mer unique DNA sequence
cacgaactaagccaacggcg

SEQ ID NO: 8134 - DNA, 20 bp, Artificial
  20-mer unique DNA sequence
ggcggggctgctctagtttg

SEQ ID NO: 8135 - DNA, 20 bp, Artificial
  20-mer unique DNA sequence
aaaactgcatgcgccgtcga

SEQ ID NO: 8136 - DNA, 20 bp, Artificial
  20-mer unique DNA sequence
tgggcggttcgggtgttgac

SEQ ID NO: 8137 - DNA, 20 bp, Artificial
  20-mer unique DNA sequence
ccgctttcccgccttgacta

SEQ ID NO: 8138 - DNA, 20 bp, Artificial
  20-mer unique DNA sequence
ggacaaatgcgggaagggaa

SEQ ID NO: 8139 - DNA, 20 bp, Artificial
  20-mer unique DNA sequence
gctcattcgcccccatttgt

SEQ ID NO: 8140 - DNA, 20 bp, Artificial
  20-mer unique DNA sequence
tatccccccttgagcccttt

SEQ ID NO: 8141 - DNA, 20 bp, Artificial
  20-mer unique DNA sequence
gtgggggaggggactgtgaa

SEQ ID NO: 8142 - DNA, 20 bp, Artificial
  20-mer unique DNA sequence
accgattaccttgcgcctgg

SEQ ID NO: 8143 - DNA, 20 bp, Artificial
  20-mer unique DNA sequence
tagcgcatcaacccacacgg

SEQ ID NO: 8144 - DNA, 20 bp, Artificial
  20-mer unique DNA sequence
cccgcacagatcgcacgaag

SEQ ID NO: 8145 - DNA, 20 bp, Artificial
  20-mer unique DNA sequence
cgcccctaagcacgcaaaca

SEQ ID NO: 8146 - DNA, 20 bp, Artificial
  20-mer unique DNA sequence
gaccgatccctcccagcctc

SEQ ID NO: 8147 - DNA, 20 bp, Artificial
  20-mer unique DNA sequence
ggacaccccggaaagagcag

SEQ ID NO: 8148 - DNA, 20 bp, Artificial
  20-mer unique DNA sequence
caaagtgcgcgctaatcccc

SEQ ID NO: 8149 - DNA, 20 bp, Artificial
  20-mer unique DNA sequence
gacatgcaaatacgccgccc

SEQ ID NO: 8150 - DNA, 20 bp, Artificial
  20-mer unique DNA sequence
gtggaggggcaggcaggaag

SEQ ID NO: 8151 - DNA, 20 bp, Artificial
  20-mer unique DNA sequence
aggggacgaaggcaccaggg

SEQ ID NO: 8152 - DNA, 20 bp, Artificial
  20-mer unique DNA sequence
aaacacccacgccaaagcct

SEQ ID NO: 8153 - DNA, 20 bp, Artificial
  20-mer unique DNA sequence
tgttgggtctggtgcggagg

SEQ ID NO: 8154 - DNA, 20 bp, Artificial
  20-mer unique DNA sequence
gcttgtcggcatgtacccgg

SEQ ID NO: 8155 - DNA, 20 bp, Artificial
  20-mer unique DNA sequence
tctaaccgtctgccccgccc

SEQ ID NO: 8156 - DNA, 20 bp, Artificial
  20-mer unique DNA sequence
acggagcacagcggggatca

SEQ ID NO: 8157 - DNA, 20 bp, Artificial
  20-mer unique DNA sequence
cctacccctgcgtgccgttc

SEQ ID NO: 8158 - DNA, 20 bp, Artificial
  20-mer unique DNA sequence
gcagcgagaggagggcaact

SEQ ID NO: 8159 - DNA, 20 bp, Artificial
  20-mer unique DNA sequence
caccgaagccagcacccgtt

SEQ ID NO: 8160 - DNA, 20 bp, Artificial
  20-mer unique DNA sequence
gtcgcggctggcatcttgtt

SEQ ID NO: 8161 - DNA, 20 bp, Artificial
  20-mer unique DNA sequence
tgctagcagcccctcccgac

SEQ ID NO: 8162 - DNA, 20 bp, Artificial
  20-mer unique DNA sequence
gcttcgcgatgcccaggtac

SEQ ID NO: 8163 - DNA, 20 bp, Artificial
  20-mer unique DNA sequence
gtggaacccagtggctgcaa

SEQ ID NO: 8164 - DNA, 20 bp, Artificial
  20-mer unique DNA sequence
gggcgcttgtctcggttgtg

SEQ ID NO: 8165 - DNA, 20 bp, Artificial
  20-mer unique DNA sequence
ggggtacgcctggtgcaatt

SEQ ID NO: 8166 - DNA, 20 bp, Artificial
  20-mer unique DNA sequence
gcctacgtcgctcccctgcc

SEQ ID NO: 8167 - DNA, 20 bp, Artificial
  20-mer unique DNA sequence
atggagagatggcgacggcg

SEQ ID NO: 8168 - DNA, 20 bp, Artificial
  20-mer unique DNA sequence
cagcaccgtgatccgacact

SEQ ID NO: 8169 - DNA, 20 bp, Artificial
  20-mer unique DNA sequence
ctacatgcgtcgcactggca

SEQ ID NO: 8170 - DNA, 20 bp, Artificial
  20-mer unique DNA sequence
tcacgtcggtcgaagcagtc

SEQ ID NO: 8171 - DNA, 20 bp, Artificial
  20-mer unique DNA sequence
acactgcagctagggcgcaa

SEQ ID NO: 8172 - DNA, 20 bp, Artificial
  20-mer unique DNA sequence
ccatccgggtccaaatcgaa

SEQ ID NO: 8173 - DNA, 20 bp, Artificial
  20-mer unique DNA sequence
gggtgcttgtgggcggattt

SEQ ID NO: 8174 - DNA, 20 bp, Artificial
  20-mer unique DNA sequence
ttgcctctctgcctcgcacc

SEQ ID NO: 8175 - DNA, 20 bp, Artificial
  20-mer unique DNA sequence
ctggaacagccccccttgga

SEQ ID NO: 8176 - DNA, 20 bp, Artificial
  20-mer unique DNA sequence
agcacgtcccatcagcaccg

SEQ ID NO: 8177 - DNA, 20 bp, Artificial
  20-mer unique DNA sequence
caaacccaagaaagcgccca

SEQ ID NO: 8178 - DNA, 20 bp, Artificial
  20-mer unique DNA sequence
taccaaagggcgacatgggc

SEQ ID NO: 8179 - DNA, 20 bp, Artificial
  20-mer unique DNA sequence
tgccattgccgataaagcgg

SEQ ID NO: 8180 - DNA, 20 bp, Artificial
  20-mer unique DNA sequence
cccgagggggtggtaggtgt

SEQ ID NO: 8181 - DNA, 20 bp, Artificial
  20-mer unique DNA sequence
ccttcggtaggagccctggc

SEQ ID NO: 8182 - DNA, 20 bp, Artificial
  20-mer unique DNA sequence
acgcaacacccaatcatccg

SEQ ID NO: 8183 - DNA, 20 bp, Artificial
  20-mer unique DNA sequence
tacttgctttgcgggcctcg

SEQ ID NO: 8184 - DNA, 20 bp, Artificial
  20-mer unique DNA sequence
atgttccattgagcgccccg

SEQ ID NO: 8185 - DNA, 20 bp, Artificial
  20-mer unique DNA sequence
gttttccccggctgacctgc

SEQ ID NO: 8186 - DNA, 20 bp, Artificial
  20-mer unique DNA sequence
gcgagtggctggtcctggaa

SEQ ID NO: 8187 - DNA, 20 bp, Artificial
  20-mer unique DNA sequence
gggcccacaaaaaaagcgca

SEQ ID NO: 8188 - DNA, 20 bp, Artificial
  20-mer unique DNA sequence
gtcatttcggggtcggcaag

SEQ ID NO: 8189 - DNA, 20 bp, Artificial
  20-mer unique DNA sequence
ggtcgggggaaagggaatgt

SEQ ID NO: 8190 - DNA, 20 bp, Artificial
  20-mer unique DNA sequence
gcgctagtggatgggcagag

SEQ ID NO: 8191 - DNA, 20 bp, Artificial
  20-mer unique DNA sequence
cggcgaacgaacgactggac

SEQ ID NO: 8192 - DNA, 20 bp, Artificial
  20-mer unique DNA sequence
tccacgttccccccgctacc

SEQ ID NO: 8193 - DNA, 20 bp, Artificial
  20-mer unique DNA sequence
ggcgcgcgtcaagtgttcag

SEQ ID NO: 8194 - DNA, 20 bp, Artificial
  20-mer unique DNA sequence
gacctccacacacccctgcg

SEQ ID NO: 8195 - DNA, 20 bp, Artificial
  20-mer unique DNA sequence
cgggggggtgagtagacgtg

SEQ ID NO: 8196 - DNA, 20 bp, Artificial
  20-mer unique DNA sequence
cagacactcgcggccaaaat

SEQ ID NO: 8197 - DNA, 20 bp, Artificial
  20-mer unique DNA sequence
tcgccggcttcgtcatcttt

SEQ ID NO: 8198 - DNA, 20 bp, Artificial
  20-mer unique DNA sequence
acagccatgcgtacgtgggt

SEQ ID NO: 8199 - DNA, 20 bp, Artificial
  20-mer unique DNA sequence
acgcggccgatctaagggta

SEQ ID NO: 8200 - DNA, 20 bp, Artificial
  20-mer unique DNA sequence
ccgtaacgcccatgcaacgc

SEQ ID NO: 8201 - DNA, 20 bp, Artificial
  20-mer unique DNA sequence
tcccagccccagctaccaga

SEQ ID NO: 8202 - DNA, 20 bp, Artificial
  20-mer unique DNA sequence
ccagagtgacccccgccaag

SEQ ID NO: 8203 - DNA, 20 bp, Artificial
  20-mer unique DNA sequence
agcaaatggtgtccgcgcag

SEQ ID NO: 8204 - DNA, 20 bp, Artificial
  20-mer unique DNA sequence
tgtggagaagcgtgatgcgg

SEQ ID NO: 8205 - DNA, 20 bp, Artificial
  20-mer unique DNA sequence
actgatgaaagcaccgcggc

SEQ ID NO: 8206 - DNA, 20 bp, Artificial
  20-mer unique DNA sequence
tctggatcaggcgcaggctt

SEQ ID NO: 8207 - DNA, 20 bp, Artificial
  20-mer unique DNA sequence
ttggcacaatgggggttccg

SEQ ID NO: 8208 - DNA, 20 bp, Artificial
  20-mer unique DNA sequence
atgatccaccaaaccggccg

SEQ ID NO: 8209 - DNA, 20 bp, Artificial
  20-mer unique DNA sequence
gcctgccacgattcgaccca

SEQ ID NO: 8210 - DNA, 20 bp, Artificial
  20-mer unique DNA sequence
gggagtcgatgccgctttgc

SEQ ID NO: 8211 - DNA, 20 bp, Artificial
  20-mer unique DNA sequence
tcataggaacggggctgcgt

SEQ ID NO: 8212 - DNA, 20 bp, Artificial
  20-mer unique DNA sequence
ccgctctcgcgttttcacag

SEQ ID NO: 8213 - DNA, 20 bp, Artificial
  20-mer unique DNA sequence
cggaccactccacacacccg

SEQ ID NO: 8214 - DNA, 20 bp, Artificial
  20-mer unique DNA sequence
tgaagggggggctacgctga

SEQ ID NO: 8215 - DNA, 20 bp, Artificial
  20-mer unique DNA sequence
tgatgatgggtcttgcggga

SEQ ID NO: 8216 - DNA, 20 bp, Artificial
  20-mer unique DNA sequence
tcggaagacacaccatcggg

SEQ ID NO: 8217 - DNA, 20 bp, Artificial
  20-mer unique DNA sequence
gtgtgtggtcggtgcgtcgg

SEQ ID NO: 8218 - DNA, 20 bp, Artificial
  20-mer unique DNA sequence
caaccggccacacatttccc

SEQ ID NO: 8219 - DNA, 20 bp, Artificial
  20-mer unique DNA sequence
ttgcccgcggaggtatcgta

SEQ ID NO: 8220 - DNA, 20 bp, Artificial
  20-mer unique DNA sequence
actcgaactgcatggggaca

SEQ ID NO: 8221 - DNA, 20 bp, Artificial
  20-mer unique DNA sequence
gtagacggttgggggaggcg

SEQ ID NO: 8222 - DNA, 20 bp, Artificial
  20-mer unique DNA sequence
cgggggttgtcattcggtcg

SEQ ID NO: 8223 - DNA, 20 bp, Artificial
  20-mer unique DNA sequence
cccccgacgcgtttatcctt

SEQ ID NO: 8224 - DNA, 20 bp, Artificial
  20-mer unique DNA sequence
cgatgggacggcggtagcta

SEQ ID NO: 8225 - DNA, 20 bp, Artificial
  20-mer unique DNA sequence
cattcgaagaggcaacgggc

SEQ ID NO: 8226 - DNA, 20 bp, Artificial
  20-mer unique DNA sequence
tgtgggcggagtgtgtgctc

SEQ ID NO: 8227 - DNA, 20 bp, Artificial
  20-mer unique DNA sequence
tggagtgtattgggggggga

SEQ ID NO: 8228 - DNA, 20 bp, Artificial
  20-mer unique DNA sequence
gccctcctacacctgccgtc

SEQ ID NO: 8229 - DNA, 20 bp, Artificial
  20-mer unique DNA sequence
agcacaccaaacacaggcgg

SEQ ID NO: 8230 - DNA, 20 bp, Artificial
  20-mer unique DNA sequence
aattcccgacctgcccaccc

SEQ ID NO: 8231 - DNA, 20 bp, Artificial
  20-mer unique DNA sequence
agaccggggcacttaggcag

SEQ ID NO: 8232 - DNA, 20 bp, Artificial
  20-mer unique DNA sequence
ccagttgccctcagccgtct

SEQ ID NO: 8233 - DNA, 20 bp, Artificial
  20-mer unique DNA sequence
agaaaagggagaggggcgga

SEQ ID NO: 8234 - DNA, 20 bp, Artificial
  20-mer unique DNA sequence
acggaccacaccccctcgtc

SEQ ID NO: 8235 - DNA, 20 bp, Artificial
  20-mer unique DNA sequence
ggcaaggacatcgggtggaa

SEQ ID NO: 8236 - DNA, 20 bp, Artificial
  20-mer unique DNA sequence
acatccgcgtactgctccca

SEQ ID NO: 8237 - DNA, 20 bp, Artificial
  20-mer unique DNA sequence
tcgctacgggtctgacttcg

SEQ ID NO: 8238 - DNA, 20 bp, Artificial
  20-mer unique DNA sequence
acacaggggttgggcgggac

SEQ ID NO: 8239 - DNA, 20 bp, Artificial
  20-mer unique DNA sequence
ggttgaatgcgtccggtcgt

SEQ ID NO: 8240 - DNA, 20 bp, Artificial
  20-mer unique DNA sequence
tccccaatcccgcatcacga

SEQ ID NO: 8241 - DNA, 20 bp, Artificial
  20-mer unique DNA sequence
aagccaccccgctgccaaat

SEQ ID NO: 8242 - DNA, 20 bp, Artificial
  20-mer unique DNA sequence
cgcgggattgcattgtgtga

SEQ ID NO: 8243 - DNA, 20 bp, Artificial
  20-mer unique DNA sequence
cgagggagtggagtgggggc

SEQ ID NO: 8244 - DNA, 20 bp, Artificial
  20-mer unique DNA sequence
gcgggtaacttggcggtcgt

SEQ ID NO: 8245 - DNA, 20 bp, Artificial
  20-mer unique DNA sequence
ccggtggcgagaacccttta

SEQ ID NO: 8246 - DNA, 20 bp, Artificial
  20-mer unique DNA sequence
ggcgttggggggggactaca

SEQ ID NO: 8247 - DNA, 20 bp, Artificial
  20-mer unique DNA sequence
ggcacgaccgcaaccaccct

SEQ ID NO: 8248 - DNA, 20 bp, Artificial
  20-mer unique DNA sequence
cctgcccctaaaacccgtgc

SEQ ID NO: 8249 - DNA, 20 bp, Artificial
  20-mer unique DNA sequence
tttccccccgtttcgttcaa

SEQ ID NO: 8250 - DNA, 20 bp, Artificial
  20-mer unique DNA sequence
tcgccgtgtctgagcgctat

SEQ ID NO: 8251 - DNA, 20 bp, Artificial
  20-mer unique DNA sequence
gcgaggcttatgtccggtga

SEQ ID NO: 8252 - DNA, 20 bp, Artificial
  20-mer unique DNA sequence
tcatgacctcgcctctcccg

SEQ ID NO: 8253 - DNA, 20 bp, Artificial
  20-mer unique DNA sequence
gggttgagggtacggttgcg

SEQ ID NO: 8254 - DNA, 20 bp, Artificial
  20-mer unique DNA sequence
ggcgagaacggcgaacacct

SEQ ID NO: 8255 - DNA, 20 bp, Artificial
  20-mer unique DNA sequence
cgcgcgagatacgaatgagg

SEQ ID NO: 8256 - DNA, 20 bp, Artificial
  20-mer unique DNA sequence
tgatgggctccacggaaacc

SEQ ID NO: 8257 - DNA, 20 bp, Artificial
  20-mer unique DNA sequence
gcaacccaccgtacgaaggc

SEQ ID NO: 8258 - DNA, 20 bp, Artificial
  20-mer unique DNA sequence
gcgatttgcatggacgcgta

SEQ ID NO: 8259 - DNA, 20 bp, Artificial
  20-mer unique DNA sequence
taggcaaaccgggcacacac

SEQ ID NO: 8260 - DNA, 20 bp, Artificial
  20-mer unique DNA sequence
gccaggggaggagcgaacaa

SEQ ID NO: 8261 - DNA, 20 bp, Artificial
  20-mer unique DNA sequence
agaggatccatagcgggcga

SEQ ID NO: 8262 - DNA, 20 bp, Artificial
  20-mer unique DNA sequence
cggcgccacactccctaatc

SEQ ID NO: 8263 - DNA, 20 bp, Artificial
  20-mer unique DNA sequence
ttgctgcgcggttaaagtgg

SEQ ID NO: 8264 - DNA, 20 bp, Artificial
  20-mer unique DNA sequence
actcccctccgcgttgaatg

SEQ ID NO: 8265 - DNA, 20 bp, Artificial
  20-mer unique DNA sequence
cacgggctggatgacggagg

SEQ ID NO: 8266 - DNA, 20 bp, Artificial
  20-mer unique DNA sequence
tagaccggatcccaagggcg

SEQ ID NO: 8267 - DNA, 20 bp, Artificial
  20-mer unique DNA sequence
tcagggcgtcagggtcacaa

SEQ ID NO: 8268 - DNA, 20 bp, Artificial
  20-mer unique DNA sequence
ggattaacccgggccctgac

SEQ ID NO: 8269 - DNA, 20 bp, Artificial
  20-mer unique DNA sequence
cggcccctggaacttttggt

SEQ ID NO: 8270 - DNA, 20 bp, Artificial
  20-mer unique DNA sequence
gcggcaatgaggggggagtt

SEQ ID NO: 8271 - DNA, 20 bp, Artificial
  20-mer unique DNA sequence
aaccggtgtcccccatgaag

SEQ ID NO: 8272 - DNA, 20 bp, Artificial
  20-mer unique DNA sequence
cctagaccctccaatcgcgg

SEQ ID NO: 8273 - DNA, 20 bp, Artificial
  20-mer unique DNA sequence
acggggctttcgtgcttgtt

SEQ ID NO: 8274 - DNA, 20 bp, Artificial
  20-mer unique DNA sequence
ctacccgccgccccttagtt

SEQ ID NO: 8275 - DNA, 20 bp, Artificial
  20-mer unique DNA sequence
aaggcgatagggggtgagca

SEQ ID NO: 8276 - DNA, 20 bp, Artificial
  20-mer unique DNA sequence
ccgcaatacgtcacagcagc

SEQ ID NO: 8277 - DNA, 20 bp, Artificial
  20-mer unique DNA sequence
cctttcgacttccatcccgc

SEQ ID NO: 8278 - DNA, 20 bp, Artificial
  20-mer unique DNA sequence
catcccgccctgacaccttg

SEQ ID NO: 8279 - DNA, 20 bp, Artificial
  20-mer unique DNA sequence
accgccctgccactgttagc

SEQ ID NO: 8280 - DNA, 20 bp, Artificial
  20-mer unique DNA sequence
tgttacagcgggccgtacaa

SEQ ID NO: 8281 - DNA, 20 bp, Artificial
  20-mer unique DNA sequence
cactcgttccgacacggact

SEQ ID NO: 8282 - DNA, 20 bp, Artificial
  20-mer unique DNA sequence
tacctgggaactgcggcctt

SEQ ID NO: 8283 - DNA, 20 bp, Artificial
  20-mer unique DNA sequence
gccgagcgcagagtacccac

SEQ ID NO: 8284 - DNA, 20 bp, Artificial
  20-mer unique DNA sequence
ggtgcgggatggtacggttg

SEQ ID NO: 8285 - DNA, 20 bp, Artificial
  20-mer unique DNA sequence
aactactgctgcgcccccgg

SEQ ID NO: 8286 - DNA, 20 bp, Artificial
  20-mer unique DNA sequence
cggttcgaggtgtgaggcgc

SEQ ID NO: 8287 - DNA, 20 bp, Artificial
  20-mer unique DNA sequence
aatgggggaactttggcgtg

SEQ ID NO: 8288 - DNA, 20 bp, Artificial
  20-mer unique DNA sequence
cagctccgtgacggcgatta

SEQ ID NO: 8289 - DNA, 20 bp, Artificial
  20-mer unique DNA sequence
atggttccccctgtttgccc

SEQ ID NO: 8290 - DNA, 20 bp, Artificial
  20-mer unique DNA sequence
aacggtcaggggtcggggtc

SEQ ID NO: 8291 - DNA, 20 bp, Artificial
  20-mer unique DNA sequence
ctcaaggatcgggggcgcta

SEQ ID NO: 8292 - DNA, 20 bp, Artificial
  20-mer unique DNA sequence
ccccctccgggtttttgagt

SEQ ID NO: 8293 - DNA, 20 bp, Artificial
  20-mer unique DNA sequence
ggcaaacggggcagagggta

SEQ ID NO: 8294 - DNA, 20 bp, Artificial
  20-mer unique DNA sequence
tttacggggtgcgctttcca

SEQ ID NO: 8295 - DNA, 20 bp, Artificial
  20-mer unique DNA sequence
ttcacaagcgagccgtcacc

SEQ ID NO: 8296 - DNA, 20 bp, Artificial
  20-mer unique DNA sequence
ttctctgtcgcccccaccgt

SEQ ID NO: 8297 - DNA, 20 bp, Artificial
  20-mer unique DNA sequence
tgtacgtcatcctccggccg

SEQ ID NO: 8298 - DNA, 20 bp, Artificial
  20-mer unique DNA sequence
accgcaagaggtggccaatc

SEQ ID NO: 8299 - DNA, 20 bp, Artificial
  20-mer unique DNA sequence
tctccacccgcggtagatca

SEQ ID NO: 8300 - DNA, 20 bp, Artificial
  20-mer unique DNA sequence
acgtcacccaaccagcctcc

SEQ ID NO: 8301 - DNA, 20 bp, Artificial
  20-mer unique DNA sequence
taccggccgaagaagcaagg

SEQ ID NO: 8302 - DNA, 20 bp, Artificial
  20-mer unique DNA sequence
gcgcactccagtgcatgaga

SEQ ID NO: 8303 - DNA, 20 bp, Artificial
  20-mer unique DNA sequence
gtcgactcggcatgtgccat

SEQ ID NO: 8304 - DNA, 20 bp, Artificial
  20-mer unique DNA sequence
cgcatttcaaccccctcgct

SEQ ID NO: 8305 - DNA, 20 bp, Artificial
  20-mer unique DNA sequence
cagcgccttcattccccgtg

SEQ ID NO: 8306 - DNA, 20 bp, Artificial
  20-mer unique DNA sequence
tggcgatatgcacgtagcgt

SEQ ID NO: 8307 - DNA, 20 bp, Artificial
  20-mer unique DNA sequence
gggctcggggttttagcgtt

SEQ ID NO: 8308 - DNA, 20 bp, Artificial
  20-mer unique DNA sequence
agagggcttgcggatggtcg

SEQ ID NO: 8309 - DNA, 20 bp, Artificial
  20-mer unique DNA sequence
aggggaatggttctgggcgt

SEQ ID NO: 8310 - DNA, 20 bp, Artificial
  20-mer unique DNA sequence
gggtaagcaggcaagcgggt

SEQ ID NO: 8311 - DNA, 20 bp, Artificial
  20-mer unique DNA sequence
tgcccgaacccccattttag

SEQ ID NO: 8312 - DNA, 20 bp, Artificial
  20-mer unique DNA sequence
aacctgggcttccgtagggt

SEQ ID NO: 8313 - DNA, 20 bp, Artificial
  20-mer unique DNA sequence
atgggcctggggtcggaaac

SEQ ID NO: 8314 - DNA, 20 bp, Artificial
  20-mer unique DNA sequence
tgatcacggagcccaacgcc

SEQ ID NO: 8315 - DNA, 20 bp, Artificial
  20-mer unique DNA sequence
ttagctgcgtgggcccttgt

SEQ ID NO: 8316 - DNA, 20 bp, Artificial
  20-mer unique DNA sequence
taaggggggtggctggaagc

SEQ ID NO: 8317 - DNA, 20 bp, Artificial
  20-mer unique DNA sequence
ttcggtcgctgggtcgtctt

SEQ ID NO: 8318 - DNA, 20 bp, Artificial
  20-mer unique DNA sequence
cgccgggcccttaggacaac

SEQ ID NO: 8319 - DNA, 20 bp, Artificial
  20-mer unique DNA sequence
ccctccccaaggcccatcag

SEQ ID NO: 8320 - DNA, 20 bp, Artificial
  20-mer unique DNA sequence
tcagcccctcatcacgcgtt

SEQ ID NO: 8321 - DNA, 20 bp, Artificial
  20-mer unique DNA sequence
ctacgcgccctttccaccaa

SEQ ID NO: 8322 - DNA, 20 bp, Artificial
  20-mer unique DNA sequence
ccccagccagtaaaagccag

SEQ ID NO: 8323 - DNA, 20 bp, Artificial
  20-mer unique DNA sequence
atgagggtgggggtccgttg

SEQ ID NO: 8324 - DNA, 20 bp, Artificial
  20-mer unique DNA sequence
actcggcaaggcaatgggaa

SEQ ID NO: 8325 - DNA, 20 bp, Artificial
  20-mer unique DNA sequence
aggtcccccacccgtaccaa

SEQ ID NO: 8326 - DNA, 20 bp, Artificial
  20-mer unique DNA sequence
cggctcctccaccaagctag

SEQ ID NO: 8327 - DNA, 20 bp, Artificial
  20-mer unique DNA sequence
tccgacacccccaccgtaag

SEQ ID NO: 8328 - DNA, 20 bp, Artificial
  20-mer unique DNA sequence
ctcttggggttggatggccg

SEQ ID NO: 8329 - DNA, 20 bp, Artificial
  20-mer unique DNA sequence
agacgcgggggatttttgtg

SEQ ID NO: 8330 - DNA, 20 bp, Artificial
  20-mer unique DNA sequence
cctatcggccccttcgttca

SEQ ID NO: 8331 - DNA, 20 bp, Artificial
  20-mer unique DNA sequence
caaagcaagtcccccgtccc

SEQ ID NO: 8332 - DNA, 20 bp, Artificial
  20-mer unique DNA sequence
gaaggtgggcgacaaacgga

SEQ ID NO: 8333 - DNA, 20 bp, Artificial
  20-mer unique DNA sequence
gtgcttcttcgtggtggcgg

SEQ ID NO: 8334 - DNA, 20 bp, Artificial
  20-mer unique DNA sequence
gggggaaggcgaaaagcaga

SEQ ID NO: 8335 - DNA, 20 bp, Artificial
  20-mer unique DNA sequence
ggcagaggtgacggcaagcg

SEQ ID NO: 8336 - DNA, 20 bp, Artificial
  20-mer unique DNA sequence
gccggccaccacacactcaa

SEQ ID NO: 8337 - DNA, 20 bp, Artificial
  20-mer unique DNA sequence
accgccagccctcacatttg

SEQ ID NO: 8338 - DNA, 20 bp, Artificial
  20-mer unique DNA sequence
tttccccatccctcgccctg

SEQ ID NO: 8339 - DNA, 20 bp, Artificial
  20-mer unique DNA sequence
aggaggcggcaatgtgaggc

SEQ ID NO: 8340 - DNA, 20 bp, Artificial
  20-mer unique DNA sequence
tgcgggagggacaggggtaa

SEQ ID NO: 8341 - DNA, 20 bp, Artificial
  20-mer unique DNA sequence
taggagtgtgcggggacggg

SEQ ID NO: 8342 - DNA, 20 bp, Artificial
  20-mer unique DNA sequence
aagcgggggttaggagggtg

SEQ ID NO: 8343 - DNA, 20 bp, Artificial
  20-mer unique DNA sequence
acgttctttgcggccgggtc

SEQ ID NO: 8344 - DNA, 20 bp, Artificial
  20-mer unique DNA sequence
tacgacgtagtcaccgcgtg

SEQ ID NO: 8345 - DNA, 20 bp, Artificial
  20-mer unique DNA sequence
ttcacgcccccctataccgc

SEQ ID NO: 8346 - DNA, 20 bp, Artificial
  20-mer unique DNA sequence
ccgtgcgatcgcctgagtaa

SEQ ID NO: 8347 - DNA, 20 bp, Artificial
  20-mer unique DNA sequence
agtaatgcacgctgcgcgag

SEQ ID NO: 8348 - DNA, 20 bp, Artificial
  20-mer unique DNA sequence
cccagtgccgattgacctct

SEQ ID NO: 8349 - DNA, 20 bp, Artificial
  20-mer unique DNA sequence
atcccgacctctaggcggta

SEQ ID NO: 8350 - DNA, 20 bp, Artificial
  20-mer unique DNA sequence
tcaggcgctgtgaggtccaa

SEQ ID NO: 8351 - DNA, 20 bp, Artificial
  20-mer unique DNA sequence
tagagagccgctgtcacgca

SEQ ID NO: 8352 - DNA, 20 bp, Artificial
  20-mer unique DNA sequence
ccctccacccttgtccaccg

SEQ ID NO: 8353 - DNA, 20 bp, Artificial
  20-mer unique DNA sequence
tggttgccgactttctcccg

SEQ ID NO: 8354 - DNA, 20 bp, Artificial
  20-mer unique DNA sequence
tgctgctctgtgacgctacg

SEQ ID NO: 8355 - DNA, 20 bp, Artificial
  20-mer unique DNA sequence
gtcatgacgagctcggtcca

SEQ ID NO: 8356 - DNA, 20 bp, Artificial
  20-mer unique DNA sequence
ctcacgtgcgcggcatttaa

SEQ ID NO: 8357 - DNA, 20 bp, Artificial
  20-mer unique DNA sequence
cttctgccctgctcgtcccg

SEQ ID NO: 8358 - DNA, 20 bp, Artificial
  20-mer unique DNA sequence
tgtggcgagcgctgttttga

SEQ ID NO: 8359 - DNA, 20 bp, Artificial
  20-mer unique DNA sequence
cggagctcggctttggtcat

SEQ ID NO: 8360 - DNA, 20 bp, Artificial
  20-mer unique DNA sequence
cgagggagagtttggcgcag

SEQ ID NO: 8361 - DNA, 20 bp, Artificial
  20-mer unique DNA sequence
tctgcgccaaaatctcccgg

SEQ ID NO: 8362 - DNA, 20 bp, Artificial
  20-mer unique DNA sequence
cgaatgcgccgaggtaagct

SEQ ID NO: 8363 - DNA, 20 bp, Artificial
  20-mer unique DNA sequence
gggcggcggttgtgttgttg

SEQ ID NO: 8364 - DNA, 20 bp, Artificial
  20-mer unique DNA sequence
tccaccttaatcccgcggcc

SEQ ID NO: 8365 - DNA, 20 bp, Artificial
  20-mer unique DNA sequence
tcaaatggcagggggcaagc

SEQ ID NO: 8366 - DNA, 20 bp, Artificial
  20-mer unique DNA sequence
gggttgggtttagtcgccgg

SEQ ID NO: 8367 - DNA, 20 bp, Artificial
  20-mer unique DNA sequence
acgcgagacttcagaggggc

SEQ ID NO: 8368 - DNA, 20 bp, Artificial
  20-mer unique DNA sequence
tggccggctgctttgattcc

SEQ ID NO: 8369 - DNA, 20 bp, Artificial
  20-mer unique DNA sequence
tccttgtggggcgcgagctt

SEQ ID NO: 8370 - DNA, 20 bp, Artificial
  20-mer unique DNA sequence
ttagcgtggcctggtgtcga

SEQ ID NO: 8371 - DNA, 20 bp, Artificial
  20-mer unique DNA sequence
ccaccaattgccagcgtccc

SEQ ID NO: 8372 - DNA, 20 bp, Artificial
  20-mer unique DNA sequence
tgcgcccactaggaaagccg

SEQ ID NO: 8373 - DNA, 20 bp, Artificial
  20-mer unique DNA sequence
gcgttgcagcggttaatgga

SEQ ID NO: 8374 - DNA, 20 bp, Artificial
  20-mer unique DNA sequence
gagtatggggggttccgcgg

SEQ ID NO: 8375 - DNA, 20 bp, Artificial
  20-mer unique DNA sequence
gcgcgcggagactggtgaac

SEQ ID NO: 8376 - DNA, 20 bp, Artificial
  20-mer unique DNA sequence
tgtgcgtttgagcgatgggt

SEQ ID NO: 8377 - DNA, 20 bp, Artificial
  20-mer unique DNA sequence
actcccgctcgcaacaccat

SEQ ID NO: 8378 - DNA, 20 bp, Artificial
  20-mer unique DNA sequence
actccctcggcctttctcaa

SEQ ID NO: 8379 - DNA, 20 bp, Artificial
  20-mer unique DNA sequence
gccattcagtccgttcgccc

SEQ ID NO: 8380 - DNA, 20 bp, Artificial
  20-mer unique DNA sequence
tgggggtcgccggatggtat

SEQ ID NO: 8381 - DNA, 20 bp, Artificial
  20-mer unique DNA sequence
atgcacctacccacccgcga

SEQ ID NO: 8382 - DNA, 20 bp, Artificial
  20-mer unique DNA sequence
ggagtaaggggccgcgaggt

SEQ ID NO: 8383 - DNA, 20 bp, Artificial
  20-mer unique DNA sequence
gcgcgcgttttgtatgctca

SEQ ID NO: 8384 - DNA, 20 bp, Artificial
  20-mer unique DNA sequence
ggaaaccacacacggccgct

SEQ ID NO: 8385 - DNA, 20 bp, Artificial
  20-mer unique DNA sequence
cgtccgcatcatctccccca

SEQ ID NO: 8386 - DNA, 20 bp, Artificial
  20-mer unique DNA sequence
acgctgcgtcatggtcaagt

SEQ ID NO: 8387 - DNA, 20 bp, Artificial
  20-mer unique DNA sequence
gattcacatggcacccaggc

SEQ ID NO: 8388 - DNA, 20 bp, Artificial
  20-mer unique DNA sequence
gcggatcgctgactcgttct

SEQ ID NO: 8389 - DNA, 20 bp, Artificial
  20-mer unique DNA sequence
tgactggccacactacgggt

SEQ ID NO: 8390 - DNA, 20 bp, Artificial
  20-mer unique DNA sequence
gtaccgctcgctaggctcat

SEQ ID NO: 8391 - DNA, 20 bp, Artificial
  20-mer unique DNA sequence
tccctgatgggtcccaaacg

SEQ ID NO: 8392 - DNA, 20 bp, Artificial
  20-mer unique DNA sequence
ccccccgtggctactcgaat

SEQ ID NO: 8393 - DNA, 20 bp, Artificial
  20-mer unique DNA sequence
gagtggattcgggggggacg

SEQ ID NO: 8394 - DNA, 20 bp, Artificial
  20-mer unique DNA sequence
ccgcgcctgccaatatctga

SEQ ID NO: 8395 - DNA, 20 bp, Artificial
  20-mer unique DNA sequence
ccctcacaaacgccacgatg

SEQ ID NO: 8396 - DNA, 20 bp, Artificial
  20-mer unique DNA sequence
gtattctcgcctgcaacgcg

SEQ ID NO: 8397 - DNA, 20 bp, Artificial
  20-mer unique DNA sequence
agtggagcgcgaagtgcatg

SEQ ID NO: 8398 - DNA, 20 bp, Artificial
  20-mer unique DNA sequence
agcgagatcgcacctgtagc

SEQ ID NO: 8399 - DNA, 20 bp, Artificial
  20-mer unique DNA sequence
aaccgttaggtccgaccgtg

SEQ ID NO: 8400 - DNA, 20 bp, Artificial
  20-mer unique DNA sequence
ctgggggcgctgtcaatggt

SEQ ID NO: 8401 - DNA, 20 bp, Artificial
  20-mer unique DNA sequence
ggaaggaccggcgaaacacg

SEQ ID NO: 8402 - DNA, 20 bp, Artificial
  20-mer unique DNA sequence
tctgtcgcgggctcactctg

SEQ ID NO: 8403 - DNA, 20 bp, Artificial
  20-mer unique DNA sequence
ggccttccggttcgtaccag

SEQ ID NO: 8404 - DNA, 20 bp, Artificial
  20-mer unique DNA sequence
cgactttccccgtttcgtcc

SEQ ID NO: 8405 - DNA, 20 bp, Artificial
  20-mer unique DNA sequence
tagggcgggtgggttcagtc

SEQ ID NO: 8406 - DNA, 20 bp, Artificial
  20-mer unique DNA sequence
ctcatctaggcgcgggcgaa

SEQ ID NO: 8407 - DNA, 20 bp, Artificial
  20-mer unique DNA sequence
tttaccatccgtgcgcccga

SEQ ID NO: 8408 - DNA, 20 bp, Artificial
  20-mer unique DNA sequence
tcgctatgtttgcccgctta

SEQ ID NO: 8409 - DNA, 20 bp, Artificial
  20-mer unique DNA sequence
attcgtgcctcgttcgcctt

SEQ ID NO: 8410 - DNA, 20 bp, Artificial
  20-mer unique DNA sequence
ttgtcaaggcggcaccaggc

SEQ ID NO: 8411 - DNA, 20 bp, Artificial
  20-mer unique DNA sequence
tggccgccagttagttaggc

SEQ ID NO: 8412 - DNA, 20 bp, Artificial
  20-mer unique DNA sequence
ggggttgttaagggggtggc

SEQ ID NO: 8413 - DNA, 20 bp, Artificial
  20-mer unique DNA sequence
gctttgtggggatggagggc

SEQ ID NO: 8414 - DNA, 20 bp, Artificial
  20-mer unique DNA sequence
tcctgccacttaagccccca

SEQ ID NO: 8415 - DNA, 20 bp, Artificial
  20-mer unique DNA sequence
ttaaaagatgggatggccgc

SEQ ID NO: 8416 - DNA, 20 bp, Artificial
  20-mer unique DNA sequence
ccccccacaagttgccgtca

SEQ ID NO: 8417 - DNA, 20 bp, Artificial
  20-mer unique DNA sequence
agagaacgtttgggcgccgg

SEQ ID NO: 8418 - DNA, 20 bp, Artificial
  20-mer unique DNA sequence
ttcccgccccgactacctga

SEQ ID NO: 8419 - DNA, 20 bp, Artificial
  20-mer unique DNA sequence
cgcggatgagacgagagcaa

SEQ ID NO: 8420 - DNA, 20 bp, Artificial
  20-mer unique DNA sequence
aggagcacccgcagtggaag

SEQ ID NO: 8421 - DNA, 20 bp, Artificial
  20-mer unique DNA sequence
tcgcggtgtaatggaggcag

SEQ ID NO: 8422 - DNA, 20 bp, Artificial
  20-mer unique DNA sequence
acgtcggttcgaccgtccat

SEQ ID NO: 8423 - DNA, 20 bp, Artificial
  20-mer unique DNA sequence
tggtcggaccgtgtgacatc

SEQ ID NO: 8424 - DNA, 20 bp, Artificial
  20-mer unique DNA sequence
gccctctagttaggcacgct

SEQ ID NO: 8425 - DNA, 20 bp, Artificial
  20-mer unique DNA sequence
tgagcgcgtcctgggggata

SEQ ID NO: 8426 - DNA, 20 bp, Artificial
  20-mer unique DNA sequence
caatcaatcactggccccga

SEQ ID NO: 8427 - DNA, 20 bp, Artificial
  20-mer unique DNA sequence
cgccgtggtggatcagcttg

SEQ ID NO: 8428 - DNA, 20 bp, Artificial
  20-mer unique DNA sequence
acaagccgggggaaacctag

SEQ ID NO: 8429 - DNA, 20 bp, Artificial
  20-mer unique DNA sequence
acgtaggcgccgagggatta

SEQ ID NO: 8430 - DNA, 20 bp, Artificial
  20-mer unique DNA sequence
gatgctgggctagacggtca

SEQ ID NO: 8431 - DNA, 20 bp, Artificial
  20-mer unique DNA sequence
cagggccactcacgtcagaa

SEQ ID NO: 8432 - DNA, 20 bp, Artificial
  20-mer unique DNA sequence
tctgcaacgtggccctcctg

SEQ ID NO: 8433 - DNA, 20 bp, Artificial
  20-mer unique DNA sequence
cgaacccttcaagccaccca

SEQ ID NO: 8434 - DNA, 20 bp, Artificial
  20-mer unique DNA sequence
gcaacagggaagccacagcg

SEQ ID NO: 8435 - DNA, 20 bp, Artificial
  20-mer unique DNA sequence
gcggcgactgtgttcttgga

SEQ ID NO: 8436 - DNA, 20 bp, Artificial
  20-mer unique DNA sequence
gcctcgaccaacgcataccc

SEQ ID NO: 8437 - DNA, 20 bp, Artificial
  20-mer unique DNA sequence
accctgccgcttccgatctt

SEQ ID NO: 8438 - DNA, 20 bp, Artificial
  20-mer unique DNA sequence
cgacgggcaatagcgagacg

SEQ ID NO: 8439 - DNA, 20 bp, Artificial
  20-mer unique DNA sequence
ctctgcagggacagctccgg

SEQ ID NO: 8440 - DNA, 20 bp, Artificial
  20-mer unique DNA sequence
cgcgcgtggtgctaaatgct

SEQ ID NO: 8441 - DNA, 20 bp, Artificial
  20-mer unique DNA sequence
ggcgcgggctgtgaatgaac

SEQ ID NO: 8442 - DNA, 20 bp, Artificial
  20-mer unique DNA sequence
cgcccgatcctgacctgttt

SEQ ID NO: 8443 - DNA, 20 bp, Artificial
  20-mer unique DNA sequence
tggaggttgtcggaccggga

SEQ ID NO: 8444 - DNA, 20 bp, Artificial
  20-mer unique DNA sequence
tcgggcctaggaatgggttg

SEQ ID NO: 8445 - DNA, 20 bp, Artificial
  20-mer unique DNA sequence
caccgcgcgcacaaatctcg

SEQ ID NO: 8446 - DNA, 20 bp, Artificial
  20-mer unique DNA sequence
tatgcccgcccaatttcccc

SEQ ID NO: 8447 - DNA, 20 bp, Artificial
  20-mer unique DNA sequence
ccggccggatgacttactgc

SEQ ID NO: 8448 - DNA, 20 bp, Artificial
  20-mer unique DNA sequence
cgtttgtcaccggcgatctg

SEQ ID NO: 8449 - DNA, 20 bp, Artificial
  20-mer unique DNA sequence
cgcggggggggataagcttc

SEQ ID NO: 8450 - DNA, 20 bp, Artificial
  20-mer unique DNA sequence
cacgtcatggggttggggaa

SEQ ID NO: 8451 - DNA, 20 bp, Artificial
  20-mer unique DNA sequence
ggcgggcttgttagggctgg

SEQ ID NO: 8452 - DNA, 20 bp, Artificial
  20-mer unique DNA sequence
ttcagacgagcaccggggag

SEQ ID NO: 8453 - DNA, 20 bp, Artificial
  20-mer unique DNA sequence
tccctgcccccggtaccatt

SEQ ID NO: 8454 - DNA, 20 bp, Artificial
  20-mer unique DNA sequence
ctcggggtctgggctttgct

SEQ ID NO: 8455 - DNA, 20 bp, Artificial
  20-mer unique DNA sequence
cctcagtcccccgcaaacct

SEQ ID NO: 8456 - DNA, 20 bp, Artificial
  20-mer unique DNA sequence
cggcaagaatcgggcgaagt

SEQ ID NO: 8457 - DNA, 20 bp, Artificial
  20-mer unique DNA sequence
gcgcataacgtgtcctccca

SEQ ID NO: 8458 - DNA, 20 bp, Artificial
  20-mer unique DNA sequence
ggggcgtcgtggttgtctgt

SEQ ID NO: 8459 - DNA, 20 bp, Artificial
  20-mer unique DNA sequence
gcgggcaggtgggactcaag

SEQ ID NO: 8460 - DNA, 20 bp, Artificial
  20-mer unique DNA sequence
cgatcttcgcgctaaccgct

SEQ ID NO: 8461 - DNA, 20 bp, Artificial
  20-mer unique DNA sequence
ccgtgacaaatccgcttccc

SEQ ID NO: 8462 - DNA, 20 bp, Artificial
  20-mer unique DNA sequence
tccatagccaacacggtcgc

SEQ ID NO: 8463 - DNA, 20 bp, Artificial
  20-mer unique DNA sequence
aaagcccccctctcgatgcc

SEQ ID NO: 8464 - DNA, 20 bp, Artificial
  20-mer unique DNA sequence
atgggcccgtgcgtgtctcg

SEQ ID NO: 8465 - DNA, 20 bp, Artificial
  20-mer unique DNA sequence
cacgctatcgccgaccctct

SEQ ID NO: 8466 - DNA, 20 bp, Artificial
  20-mer unique DNA sequence
tgtggctttgggggactgaa

SEQ ID NO: 8467 - DNA, 20 bp, Artificial
  20-mer unique DNA sequence
atgaagcaacgcccggtagg

SEQ ID NO: 8468 - DNA, 20 bp, Artificial
  20-mer unique DNA sequence
cgtttgtttgctcagcccgg

SEQ ID NO: 8469 - DNA, 20 bp, Artificial
  20-mer unique DNA sequence
tgacccatccgccttctccc

SEQ ID NO: 8470 - DNA, 20 bp, Artificial
  20-mer unique DNA sequence
gatcggaggccacgtcgatt

SEQ ID NO: 8471 - DNA, 20 bp, Artificial
  20-mer unique DNA sequence
ttcggcctagccgtcatgtg

SEQ ID NO: 8472 - DNA, 20 bp, Artificial
  20-mer unique DNA sequence
gtgccctgcccgctttccta

SEQ ID NO: 8473 - DNA, 20 bp, Artificial
  20-mer unique DNA sequence
cggcgggttgaagttggtga

SEQ ID NO: 8474 - DNA, 20 bp, Artificial
  20-mer unique DNA sequence
ctgtggcttggttggcggga

SEQ ID NO: 8475 - DNA, 20 bp, Artificial
  20-mer unique DNA sequence
tccccgttgcctccactccc

SEQ ID NO: 8476 - DNA, 20 bp, Artificial
  20-mer unique DNA sequence
atcgacccagtacgcgcaag

SEQ ID NO: 8477 - DNA, 20 bp, Artificial
  20-mer unique DNA sequence
gcgcaggcagtgtaaccgat

SEQ ID NO: 8478 - DNA, 20 bp, Artificial
  20-mer unique DNA sequence
ccgctccaacccgatacgaa

SEQ ID NO: 8479 - DNA, 20 bp, Artificial
  20-mer unique DNA sequence
tccgcgactaaacctgccaa

SEQ ID NO: 8480 - DNA, 20 bp, Artificial
  20-mer unique DNA sequence
gtaaggccggccaagggggt

SEQ ID NO: 8481 - DNA, 20 bp, Artificial
  20-mer unique DNA sequence
cgccatcagacagcctcccc

SEQ ID NO: 8482 - DNA, 20 bp, Artificial
  20-mer unique DNA sequence
gccacacatttcacccgcca

SEQ ID NO: 8483 - DNA, 20 bp, Artificial
  20-mer unique DNA sequence
ttcgttgagtgggattgccg

SEQ ID NO: 8484 - DNA, 20 bp, Artificial
  20-mer unique DNA sequence
attatgcgtagcgtcccggg

SEQ ID NO: 8485 - DNA, 20 bp, Artificial
  20-mer unique DNA sequence
tgcggccgactggattcact

SEQ ID NO: 8486 - DNA, 20 bp, Artificial
  20-mer unique DNA sequence
tacgccgtcccccttcctgg

SEQ ID NO: 8487 - DNA, 20 bp, Artificial
  20-mer unique DNA sequence
aaatgctggccgaaatgcgt

SEQ ID NO: 8488 - DNA, 20 bp, Artificial
  20-mer unique DNA sequence
ccgatcaagaacccgcagga

SEQ ID NO: 8489 - DNA, 20 bp, Artificial
  20-mer unique DNA sequence
cttcacccgtcgtcagccga

SEQ ID NO: 8490 - DNA, 20 bp, Artificial
  20-mer unique DNA sequence
ggcaccaacccctccaactg

SEQ ID NO: 8491 - DNA, 20 bp, Artificial
  20-mer unique DNA sequence
actggaggtgctgggctggt

SEQ ID NO: 8492 - DNA, 20 bp, Artificial
  20-mer unique DNA sequence
tcacccgtccccttacccac

SEQ ID NO: 8493 - DNA, 20 bp, Artificial
  20-mer unique DNA sequence
acgcccgcttctgaccatgt

SEQ ID NO: 8494 - DNA, 20 bp, Artificial
  20-mer unique DNA sequence
cgagagcgcagaagcaccac

SEQ ID NO: 8495 - DNA, 20 bp, Artificial
  20-mer unique DNA sequence
cagaccgcaaccatcgcaag

SEQ ID NO: 8496 - DNA, 20 bp, Artificial
  20-mer unique DNA sequence
atcgtcgtcgcctcctgggt

SEQ ID NO: 8497 - DNA, 20 bp, Artificial
  20-mer unique DNA sequence
caaaggctgacggatgggca

SEQ ID NO: 8498 - DNA, 20 bp, Artificial
  20-mer unique DNA sequence
gactctaacgcggaccgtct

SEQ ID NO: 8499 - DNA, 20 bp, Artificial
  20-mer unique DNA sequence
caactgttccgcccaggagt

SEQ ID NO: 8500 - DNA, 20 bp, Artificial
  20-mer unique DNA sequence
cccacgccaccgctaacaaa

SEQ ID NO: 8501 - DNA, 20 bp, Artificial
  20-mer unique DNA sequence
acacttggattcggggcgag

SEQ ID NO: 8502 - DNA, 20 bp, Artificial
  20-mer unique DNA sequence
aggcagggaatcgggtctga

SEQ ID NO: 8503 - DNA, 20 bp, Artificial
  20-mer unique DNA sequence
aggcgcgggcgattttagaa

SEQ ID NO: 8504 - DNA, 20 bp, Artificial
  20-mer unique DNA sequence
cctttcccagatgccgtcgt

SEQ ID NO: 8505 - DNA, 20 bp, Artificial
  20-mer unique DNA sequence
ccgaccgctccgtatgcaag

SEQ ID NO: 8506 - DNA, 20 bp, Artificial
  20-mer unique DNA sequence
ggtgcgcctgactccgtgct

SEQ ID NO: 8507 - DNA, 20 bp, Artificial
  20-mer unique DNA sequence
acacaggaatagcccgcgcg

SEQ ID NO: 8508 - DNA, 20 bp, Artificial
  20-mer unique DNA sequence
ccgtaagggggaaagcgtcg

SEQ ID NO: 8509 - DNA, 20 bp, Artificial
  20-mer unique DNA sequence
aggcgccggtgtattggagt

SEQ ID NO: 8510 - DNA, 20 bp, Artificial
  20-mer unique DNA sequence
acggggctgttatggtcggc

SEQ ID NO: 8511 - DNA, 20 bp, Artificial
  20-mer unique DNA sequence
ttccagctgccccggtttca

SEQ ID NO: 8512 - DNA, 20 bp, Artificial
  20-mer unique DNA sequence
acctccccacgcacaacccc

SEQ ID NO: 8513 - DNA, 20 bp, Artificial
  20-mer unique DNA sequence
agccttccccgcggttcata

SEQ ID NO: 8514 - DNA, 20 bp, Artificial
  20-mer unique DNA sequence
cggagatggtgtcgggtcaa

SEQ ID NO: 8515 - DNA, 20 bp, Artificial
  20-mer unique DNA sequence
agcgggtggatgatggtgtc

SEQ ID NO: 8516 - DNA, 20 bp, Artificial
  20-mer unique DNA sequence
ggctgggcttgcgagatggt

SEQ ID NO: 8517 - DNA, 20 bp, Artificial
  20-mer unique DNA sequence
gcactcttcccgccgctatg

SEQ ID NO: 8518 - DNA, 20 bp, Artificial
  20-mer unique DNA sequence
cggatcactcgcctcatggg

SEQ ID NO: 8519 - DNA, 20 bp, Artificial
  20-mer unique DNA sequence
acgcgcgactgcaccagaga

SEQ ID NO: 8520 - DNA, 20 bp, Artificial
  20-mer unique DNA sequence
cctgaccgtgccagctatgc

SEQ ID NO: 8521 - DNA, 20 bp, Artificial
  20-mer unique DNA sequence
ccactacatcgcaacccgga

SEQ ID NO: 8522 - DNA, 20 bp, Artificial
  20-mer unique DNA sequence
gggcggggtacaagctgaac

SEQ ID NO: 8523 - DNA, 20 bp, Artificial
  20-mer unique DNA sequence
taaaagcgttgggaaccggg

SEQ ID NO: 8524 - DNA, 20 bp, Artificial
  20-mer unique DNA sequence
gagaggaaaggaaccgcgcg

SEQ ID NO: 8525 - DNA, 20 bp, Artificial
  20-mer unique DNA sequence
gcttcaaacatcgggggctc

SEQ ID NO: 8526 - DNA, 20 bp, Artificial
  20-mer unique DNA sequence
atgaagggggcaacaatcgc

SEQ ID NO: 8527 - DNA, 20 bp, Artificial
  20-mer unique DNA sequence
accctccgttcccccttcgc

SEQ ID NO: 8528 - DNA, 20 bp, Artificial
  20-mer unique DNA sequence
catccggttggctttcgtca

SEQ ID NO: 8529 - DNA, 20 bp, Artificial
  20-mer unique DNA sequence
ggttgggacgcggaataggc

SEQ ID NO: 8530 - DNA, 20 bp, Artificial
  20-mer unique DNA sequence
atgatggacggcttggggca

SEQ ID NO: 8531 - DNA, 20 bp, Artificial
  20-mer unique DNA sequence
taccagccgccagaagcccc

SEQ ID NO: 8532 - DNA, 20 bp, Artificial
  20-mer unique DNA sequence
gctatggccgtcgaaaaccg

SEQ ID NO: 8533 - DNA, 20 bp, Artificial
  20-mer unique DNA sequence
tgcccgtccattcacccaag

SEQ ID NO: 8534 - DNA, 20 bp, Artificial
  20-mer unique DNA sequence
gcaggcgcttttcggagagg

SEQ ID NO: 8535 - DNA, 20 bp, Artificial
  20-mer unique DNA sequence
ggagcatgggggctgaagtc

SEQ ID NO: 8536 - DNA, 20 bp, Artificial
  20-mer unique DNA sequence
tggctgctaggcttccgtcg

SEQ ID NO: 8537 - DNA, 20 bp, Artificial
  20-mer unique DNA sequence
cggttgctgatctccgctca

SEQ ID NO: 8538 - DNA, 20 bp, Artificial
  20-mer unique DNA sequence
ggcgtcttaccgtaggcgaa

SEQ ID NO: 8539 - DNA, 20 bp, Artificial
  20-mer unique DNA sequence
tatctaggaccgggcagcca

SEQ ID NO: 8540 - DNA, 20 bp, Artificial
  20-mer unique DNA sequence
tcgctgtcggaggtgcaaca

SEQ ID NO: 8541 - DNA, 20 bp, Artificial
  20-mer unique DNA sequence
aggccggggactttactgca

SEQ ID NO: 8542 - DNA, 20 bp, Artificial
  20-mer unique DNA sequence
tggtgtgacggttggatcgg

SEQ ID NO: 8543 - DNA, 20 bp, Artificial
  20-mer unique DNA sequence
tcccacccagtacgcatgct

SEQ ID NO: 8544 - DNA, 20 bp, Artificial
  20-mer unique DNA sequence
ctgtttgggctgggctgtgg

SEQ ID NO: 8545 - DNA, 20 bp, Artificial
  20-mer unique DNA sequence
ttcggcccagtcatgctttg

SEQ ID NO: 8546 - DNA, 20 bp, Artificial
  20-mer unique DNA sequence
tacggactgcaagggacagc

SEQ ID NO: 8547 - DNA, 20 bp, Artificial
  20-mer unique DNA sequence
tggaggtctaaggcctggca

SEQ ID NO: 8548 - DNA, 20 bp, Artificial
  20-mer unique DNA sequence
ggccggtagatggtcgcgat

SEQ ID NO: 8549 - DNA, 20 bp, Artificial
  20-mer unique DNA sequence
ggggtaaggacgcggttgag

SEQ ID NO: 8550 - DNA, 20 bp, Artificial
  20-mer unique DNA sequence
agaggccgggatcagttgca

SEQ ID NO: 8551 - DNA, 20 bp, Artificial
  20-mer unique DNA sequence
ggtgttgtggcggtgcgtac

SEQ ID NO: 8552 - DNA, 20 bp, Artificial
  20-mer unique DNA sequence
tgccctacgcttctccctcg

SEQ ID NO: 8553 - DNA, 20 bp, Artificial
  20-mer unique DNA sequence
cacggggagcgaggacagga

SEQ ID NO: 8554 - DNA, 20 bp, Artificial
  20-mer unique DNA sequence
agtggggagagagggcgagt

SEQ ID NO: 8555 - DNA, 20 bp, Artificial
  20-mer unique DNA sequence
tgtgtgatttccgtgcgccg

SEQ ID NO: 8556 - DNA, 20 bp, Artificial
  20-mer unique DNA sequence
attgcctgccgttctccgag

SEQ ID NO: 8557 - DNA, 20 bp, Artificial
  20-mer unique DNA sequence
cttttcggccggtgtatggg

SEQ ID NO: 8558 - DNA, 20 bp, Artificial
  20-mer unique DNA sequence
agcgaccagctaggacacca

SEQ ID NO: 8559 - DNA, 20 bp, Artificial
  20-mer unique DNA sequence
aagagccctgagaggccgta

SEQ ID NO: 8560 - DNA, 20 bp, Artificial
  20-mer unique DNA sequence
ggcgggacgatgagggaaag

SEQ ID NO: 8561 - DNA, 20 bp, Artificial
  20-mer unique DNA sequence
catttatacccgagcgcccg

SEQ ID NO: 8562 - DNA, 20 bp, Artificial
  20-mer unique DNA sequence
tgctcctcaaagttccccgc

SEQ ID NO: 8563 - DNA, 20 bp, Artificial
  20-mer unique DNA sequence
gggtgggattagctcggcgg

SEQ ID NO: 8564 - DNA, 20 bp, Artificial
  20-mer unique DNA sequence
ctacgattggcaggcgggtc

SEQ ID NO: 8565 - DNA, 20 bp, Artificial
  20-mer unique DNA sequence
actgaagcgctggcaaacgg

SEQ ID NO: 8566 - DNA, 20 bp, Artificial
  20-mer unique DNA sequence
cctcgtgccctcattctgcg

SEQ ID NO: 8567 - DNA, 20 bp, Artificial
  20-mer unique DNA sequence
tcgccatcacgcctttttca

SEQ ID NO: 8568 - DNA, 20 bp, Artificial
  20-mer unique DNA sequence
accaggaatgacaggcgccg

SEQ ID NO: 8569 - DNA, 20 bp, Artificial
  20-mer unique DNA sequence
taagcggccatcaaccccac

SEQ ID NO: 8570 - DNA, 20 bp, Artificial
  20-mer unique DNA sequence
ggcgcgcagcaagtaaaccc

SEQ ID NO: 8571 - DNA, 20 bp, Artificial
  20-mer unique DNA sequence
ggcgcgcgattgtatgatgt

SEQ ID NO: 8572 - DNA, 20 bp, Artificial
  20-mer unique DNA sequence
tcaacaccccaaaacacggc

SEQ ID NO: 8573 - DNA, 20 bp, Artificial
  20-mer unique DNA sequence
agggaggcacaagacaggcg

SEQ ID NO: 8574 - DNA, 20 bp, Artificial
  20-mer unique DNA sequence
agtcccgccaaattcacgtg

SEQ ID NO: 8575 - DNA, 20 bp, Artificial
  20-mer unique DNA sequence
aactaccccgacacgcagca

SEQ ID NO: 8576 - DNA, 20 bp, Artificial
  20-mer unique DNA sequence
ccttgcgccctcggttgttc

SEQ ID NO: 8577 - DNA, 20 bp, Artificial
  20-mer unique DNA sequence
gtcattgtccccctccgcac

SEQ ID NO: 8578 - DNA, 20 bp, Artificial
  20-mer unique DNA sequence
gaaccacatgcgtggcacat

SEQ ID NO: 8579 - DNA, 20 bp, Artificial
  20-mer unique DNA sequence
tttctgccgactcgcagctt

SEQ ID NO: 8580 - DNA, 20 bp, Artificial
  20-mer unique DNA sequence
ggcgatggagtttggcaggc

SEQ ID NO: 8581 - DNA, 20 bp, Artificial
  20-mer unique DNA sequence
ctattgcggctgactgcgga

SEQ ID NO: 8582 - DNA, 20 bp, Artificial
  20-mer unique DNA sequence
cacgcgatacccgaaggcaa

SEQ ID NO: 8583 - DNA, 20 bp, Artificial
  20-mer unique DNA sequence
accggggagtcattgcaggc

SEQ ID NO: 8584 - DNA, 20 bp, Artificial
  20-mer unique DNA sequence
gtgacgacgggtttccgggg

SEQ ID NO: 8585 - DNA, 20 bp, Artificial
  20-mer unique DNA sequence
aatcaacgcgggcacaggag

SEQ ID NO: 8586 - DNA, 20 bp, Artificial
  20-mer unique DNA sequence
agcacctcggagtctaacgc

SEQ ID NO: 8587 - DNA, 20 bp, Artificial
  20-mer unique DNA sequence
tcgtggcacagacactcggt

SEQ ID NO: 8588 - DNA, 20 bp, Artificial
  20-mer unique DNA sequence
tcagggcgcgggtcatattt

SEQ ID NO: 8589 - DNA, 20 bp, Artificial
  20-mer unique DNA sequence
agaaccacgcgcctccaatg

SEQ ID NO: 8590 - DNA, 20 bp, Artificial
  20-mer unique DNA sequence
acctgcggcgcgactacaca

SEQ ID NO: 8591 - DNA, 20 bp, Artificial
  20-mer unique DNA sequence
cgtccaatcacggccacaga

SEQ ID NO: 8592 - DNA, 20 bp, Artificial
  20-mer unique DNA sequence
acccaaaaggacgcccacgg

SEQ ID NO: 8593 - DNA, 20 bp, Artificial
  20-mer unique DNA sequence
cgggccagaaaccaccagac

SEQ ID NO: 8594 - DNA, 20 bp, Artificial
  20-mer unique DNA sequence
tggctcactaatcccggcgg

SEQ ID NO: 8595 - DNA, 20 bp, Artificial
  20-mer unique DNA sequence
tggtggccggcgaaagactt

SEQ ID NO: 8596 - DNA, 20 bp, Artificial
  20-mer unique DNA sequence
gaagagggacgcacaaccgg

SEQ ID NO: 8597 - DNA, 20 bp, Artificial
  20-mer unique DNA sequence
agatgcgtggggaggtgtgg

SEQ ID NO: 8598 - DNA, 20 bp, Artificial
  20-mer unique DNA sequence
aaaagcgggccaggaattga

SEQ ID NO: 8599 - DNA, 20 bp, Artificial
  20-mer unique DNA sequence
aagcgggattcgggttttga

SEQ ID NO: 8600 - DNA, 20 bp, Artificial
  20-mer unique DNA sequence
tcacacggggagaactgggc

SEQ ID NO: 8601 - DNA, 20 bp, Artificial
  20-mer unique DNA sequence
ccatgtctgttgtgggggcg

SEQ ID NO: 8602 - DNA, 20 bp, Artificial
  20-mer unique DNA sequence
tactgccttgcctcaccccg

SEQ ID NO: 8603 - DNA, 20 bp, Artificial
  20-mer unique DNA sequence
tcatcgcgaattcacccccc

SEQ ID NO: 8604 - DNA, 20 bp, Artificial
  20-mer unique DNA sequence
gggccgggggaagagagaac

SEQ ID NO: 8605 - DNA, 20 bp, Artificial
  20-mer unique DNA sequence
ctggccccggtgtgaatgtc

SEQ ID NO: 8606 - DNA, 20 bp, Artificial
  20-mer unique DNA sequence
cggtggggtggatgtcgatg

SEQ ID NO: 8607 - DNA, 20 bp, Artificial
  20-mer unique DNA sequence
gcagacaatcagggacggcg

SEQ ID NO: 8608 - DNA, 20 bp, Artificial
  20-mer unique DNA sequence
tcgttcccaccgtatcccgc

SEQ ID NO: 8609 - DNA, 20 bp, Artificial
  20-mer unique DNA sequence
ggagttggcggagtaggggg

SEQ ID NO: 8610 - DNA, 20 bp, Artificial
  20-mer unique DNA sequence
acgaccctgccaaccgattt

SEQ ID NO: 8611 - DNA, 20 bp, Artificial
  20-mer unique DNA sequence
gggcaatatcaaacgcgggt

SEQ ID NO: 8612 - DNA, 20 bp, Artificial
  20-mer unique DNA sequence
ccacgtacacagccgccctt

SEQ ID NO: 8613 - DNA, 20 bp, Artificial
  20-mer unique DNA sequence
cgggtgggcagctaacaggt

SEQ ID NO: 8614 - DNA, 20 bp, Artificial
  20-mer unique DNA sequence
ggaaagtgtcgtgctcgcgg

SEQ ID NO: 8615 - DNA, 20 bp, Artificial
  20-mer unique DNA sequence
cgaatggaacctgaacggcg

SEQ ID NO: 8616 - DNA, 20 bp, Artificial
  20-mer unique DNA sequence
tgggcccggaatgcatgtag

SEQ ID NO: 8617 - DNA, 20 bp, Artificial
  20-mer unique DNA sequence
gtggtccggaatatgggggg

SEQ ID NO: 8618 - DNA, 20 bp, Artificial
  20-mer unique DNA sequence
agcgagaacggtaggcatgg

SEQ ID NO: 8619 - DNA, 20 bp, Artificial
  20-mer unique DNA sequence
acgggtggggggtatggctc

SEQ ID NO: 8620 - DNA, 20 bp, Artificial
  20-mer unique DNA sequence
ttgatgattgaaccccccgg

SEQ ID NO: 8621 - DNA, 20 bp, Artificial
  20-mer unique DNA sequence
gacgcccccgatgttgtacc

SEQ ID NO: 8622 - DNA, 20 bp, Artificial
  20-mer unique DNA sequence
aggggtactgaatggccgcg

SEQ ID NO: 8623 - DNA, 20 bp, Artificial
  20-mer unique DNA sequence
aggtccgtccagtccgtcgt

SEQ ID NO: 8624 - DNA, 20 bp, Artificial
  20-mer unique DNA sequence
tgcaccatggtccgactcaa

SEQ ID NO: 8625 - DNA, 20 bp, Artificial
  20-mer unique DNA sequence
tccgcgttccgttcttcctc

SEQ ID NO: 8626 - DNA, 20 bp, Artificial
  20-mer unique DNA sequence
cagcaaacgccggaggtcag

SEQ ID NO: 8627 - DNA, 20 bp, Artificial
  20-mer unique DNA sequence
gttcatacggcggcagaccc

SEQ ID NO: 8628 - DNA, 20 bp, Artificial
  20-mer unique DNA sequence
aacaacgacagccgcaccga

SEQ ID NO: 8629 - DNA, 20 bp, Artificial
  20-mer unique DNA sequence
gcggtgctaatacgggtcgg

SEQ ID NO: 8630 - DNA, 20 bp, Artificial
  20-mer unique DNA sequence
acgttgcatatccggggctc

SEQ ID NO: 8631 - DNA, 20 bp, Artificial
  20-mer unique DNA sequence
gttcttgctccccgggtcgt

SEQ ID NO: 8632 - DNA, 20 bp, Artificial
  20-mer unique DNA sequence
gctagggttgcttcgggtgg

SEQ ID NO: 8633 - DNA, 20 bp, Artificial
  20-mer unique DNA sequence
ggggtgtggtggcggtacga

SEQ ID NO: 8634 - DNA, 20 bp, Artificial
  20-mer unique DNA sequence
gctgctcaggtccgcaatgt

SEQ ID NO: 8635 - DNA, 20 bp, Artificial
  20-mer unique DNA sequence
atccgcagcctggaccaact

SEQ ID NO: 8636 - DNA, 20 bp, Artificial
  20-mer unique DNA sequence
taccccccctgacacgcatt

SEQ ID NO: 8637 - DNA, 20 bp, Artificial
  20-mer unique DNA sequence
aaaacgcgaggagggcaggg

SEQ ID NO: 8638 - DNA, 20 bp, Artificial
  20-mer unique DNA sequence
gaccatcagcgcgcccagtt

SEQ ID NO: 8639 - DNA, 20 bp, Artificial
  20-mer unique DNA sequence
ctccgcgcgtgtggtatagc

SEQ ID NO: 8640 - DNA, 20 bp, Artificial
  20-mer unique DNA sequence
ggctggggtcctttgctcgc

SEQ ID NO: 8641 - DNA, 20 bp, Artificial
  20-mer unique DNA sequence
cggacgcagagaaaacccgg

SEQ ID NO: 8642 - DNA, 20 bp, Artificial
  20-mer unique DNA sequence
tgtcgggcgaagggtcaaga

SEQ ID NO: 8643 - DNA, 20 bp, Artificial
  20-mer unique DNA sequence
acactgttcttccgcccgtt

SEQ ID NO: 8644 - DNA, 20 bp, Artificial
  20-mer unique DNA sequence
ggttcccgaatggtggtccc

SEQ ID NO: 8645 - DNA, 20 bp, Artificial
  20-mer unique DNA sequence
gggccgtccaatcaccagtt

SEQ ID NO: 8646 - DNA, 20 bp, Artificial
  20-mer unique DNA sequence
gcaccgccacgtacatccgg

SEQ ID NO: 8647 - DNA, 20 bp, Artificial
  20-mer unique DNA sequence
agcggacgcgataagaggga

SEQ ID NO: 8648 - DNA, 20 bp, Artificial
  20-mer unique DNA sequence
actcgctgaggtcaggttcg

SEQ ID NO: 8649 - DNA, 20 bp, Artificial
  20-mer unique DNA sequence
gcagtgtcgcacggagtttc

SEQ ID NO: 8650 - DNA, 20 bp, Artificial
  20-mer unique DNA sequence
ggatggggaggcgaggactg

SEQ ID NO: 8651 - DNA, 20 bp, Artificial
  20-mer unique DNA sequence
agcgccgtctgcaaagtccg

SEQ ID NO: 8652 - DNA, 20 bp, Artificial
  20-mer unique DNA sequence
cgaagacgcgccgaaggatt

SEQ ID NO: 8653 - DNA, 20 bp, Artificial
  20-mer unique DNA sequence
ggaggaaagggggcaagtgg

SEQ ID NO: 8654 - DNA, 20 bp, Artificial
  20-mer unique DNA sequence
atgcagacgcccacctttcg

SEQ ID NO: 8655 - DNA, 20 bp, Artificial
  20-mer unique DNA sequence
ttaaattggcgcggtggtcg

SEQ ID NO: 8656 - DNA, 20 bp, Artificial
  20-mer unique DNA sequence
cttatccggaccgcccctcc

SEQ ID NO: 8657 - DNA, 20 bp, Artificial
  20-mer unique DNA sequence
cagctgtgcaggaggggcgt

SEQ ID NO: 8658 - DNA, 20 bp, Artificial
  20-mer unique DNA sequence
caagttcgcggcgcagtttt

SEQ ID NO: 8659 - DNA, 20 bp, Artificial
  20-mer unique DNA sequence
agctcgtgagacggtcgtga

SEQ ID NO: 8660 - DNA, 20 bp, Artificial
  20-mer unique DNA sequence
cagtagcaggcgggcgattc

SEQ ID NO: 8661 - DNA, 20 bp, Artificial
  20-mer unique DNA sequence
aatcagtgggcgcgcaggtc

SEQ ID NO: 8662 - DNA, 20 bp, Artificial
  20-mer unique DNA sequence
tggggcgccgctatacctaa

SEQ ID NO: 8663 - DNA, 20 bp, Artificial
  20-mer unique DNA sequence
agtcgggcgcgttctctgca

SEQ ID NO: 8664 - DNA, 20 bp, Artificial
  20-mer unique DNA sequence
gccgcctcccctgtctccta

SEQ ID NO: 8665 - DNA, 20 bp, Artificial
  20-mer unique DNA sequence
gggtagcacatccgtaggca

SEQ ID NO: 8666 - DNA, 20 bp, Artificial
  20-mer unique DNA sequence
aggggccgcacgtattgagt

SEQ ID NO: 8667 - DNA, 20 bp, Artificial
  20-mer unique DNA sequence
ttctactcccagcgcagggc

SEQ ID NO: 8668 - DNA, 20 bp, Artificial
  20-mer unique DNA sequence
agcaggtgcacgcgattcta

SEQ ID NO: 8669 - DNA, 20 bp, Artificial
  20-mer unique DNA sequence
tttggcgctcgactatcgga

SEQ ID NO: 8670 - DNA, 20 bp, Artificial
  20-mer unique DNA sequence
accggaggaggacaggggac

SEQ ID NO: 8671 - DNA, 20 bp, Artificial
  20-mer unique DNA sequence
tcttgccacgccttttgtcg

SEQ ID NO: 8672 - DNA, 20 bp, Artificial
  20-mer unique DNA sequence
ctgtccgctaaccgcccgat

SEQ ID NO: 8673 - DNA, 20 bp, Artificial
  20-mer unique DNA sequence
cgatcgcccttaccacagga

SEQ ID NO: 8674 - DNA, 20 bp, Artificial
  20-mer unique DNA sequence
cctggtcagtcgacgcgaat

SEQ ID NO: 8675 - DNA, 20 bp, Artificial
  20-mer unique DNA sequence
atacgcgctgcccggataaa

SEQ ID NO: 8676 - DNA, 20 bp, Artificial
  20-mer unique DNA sequence
atcgcgcagtgtactccgtt

SEQ ID NO: 8677 - DNA, 20 bp, Artificial
  20-mer unique DNA sequence
cattacgcaggggacggctt

SEQ ID NO: 8678 - DNA, 20 bp, Artificial
  20-mer unique DNA sequence
atagtctccggcatcgcgtc

SEQ ID NO: 8679 - DNA, 20 bp, Artificial
  20-mer unique DNA sequence
gggctgtggatgtcgtcgga

SEQ ID NO: 8680 - DNA, 20 bp, Artificial
  20-mer unique DNA sequence
tacgacacggtcctgtccca

SEQ ID NO: 8681 - DNA, 20 bp, Artificial
  20-mer unique DNA sequence
agtgcctcggaagcccacat

SEQ ID NO: 8682 - DNA, 20 bp, Artificial
  20-mer unique DNA sequence
aaatagcggcccgtgttgga

SEQ ID NO: 8683 - DNA, 20 bp, Artificial
  20-mer unique DNA sequence
tcgggccctaggcaaatgtt

SEQ ID NO: 8684 - DNA, 20 bp, Artificial
  20-mer unique DNA sequence
ccgcggatgccgattgagtt

SEQ ID NO: 8685 - DNA, 20 bp, Artificial
  20-mer unique DNA sequence
ttcgggtaccctgcaacacc

SEQ ID NO: 8686 - DNA, 20 bp, Artificial
  20-mer unique DNA sequence
caacgggttgcaccgggtta

SEQ ID NO: 8687 - DNA, 20 bp, Artificial
  20-mer unique DNA sequence
tgacgtgctcacgtgcatcc

SEQ ID NO: 8688 - DNA, 20 bp, Artificial
  20-mer unique DNA sequence
acacggctgacgtgacggta

SEQ ID NO: 8689 - DNA, 20 bp, Artificial
  20-mer unique DNA sequence
atcggtccggtacccgttca

SEQ ID NO: 8690 - DNA, 20 bp, Artificial
  20-mer unique DNA sequence
acggtcaagcgacaggtgtg

SEQ ID NO: 8691 - DNA, 20 bp, Artificial
  20-mer unique DNA sequence
gcgaccacggagcacgtatt

SEQ ID NO: 8692 - DNA, 20 bp, Artificial
  20-mer unique DNA sequence
agaaacgtccggtcaggcga

SEQ ID NO: 8693 - DNA, 20 bp, Artificial
  20-mer unique DNA sequence
ggcagttgcatcggcctact

SEQ ID NO: 8694 - DNA, 20 bp, Artificial
  20-mer unique DNA sequence
agtgtatggacgctgcggac

SEQ ID NO: 8695 - DNA, 20 bp, Artificial
  20-mer unique DNA sequence
acactgtcaccgtgcgtcaa

SEQ ID NO: 8696 - DNA, 20 bp, Artificial
  20-mer unique DNA sequence
ctacgactcacgcaccccca

SEQ ID NO: 8697 - DNA, 20 bp, Artificial
  20-mer unique DNA sequence
cttcgatgaaaccgctccgc

SEQ ID NO: 8698 - DNA, 20 bp, Artificial
  20-mer unique DNA sequence
gcctattttgccggtggtgg

SEQ ID NO: 8699 - DNA, 20 bp, Artificial
  20-mer unique DNA sequence
tcccatatccacgcccgtcc

SEQ ID NO: 8700 - DNA, 20 bp, Artificial
  20-mer unique DNA sequence
agagcacaagcgcgcagagg

SEQ ID NO: 8701 - DNA, 20 bp, Artificial
  20-mer unique DNA sequence
ttccgcctcccaccgtacaa

SEQ ID NO: 8702 - DNA, 20 bp, Artificial
  20-mer unique DNA sequence
gacctcgagtacggagcgtt

SEQ ID NO: 8703 - DNA, 20 bp, Artificial
  20-mer unique DNA sequence
tagatgtcggacgtcccggt

SEQ ID NO: 8704 - DNA, 20 bp, Artificial
  20-mer unique DNA sequence
tctgcgacaggcgtcgctat

SEQ ID NO: 8705 - DNA, 20 bp, Artificial
  20-mer unique DNA sequence
ctcccagagctcggcaatga

SEQ ID NO: 8706 - DNA, 20 bp, Artificial
  20-mer unique DNA sequence
gtgcaccgctgacggttatc

SEQ ID NO: 8707 - DNA, 20 bp, Artificial
  20-mer unique DNA sequence
ctaagggcgtatgaccgcgt

SEQ ID NO: 8708 - DNA, 20 bp, Artificial
  20-mer unique DNA sequence
cgccgtaaaaacccgcaaag

SEQ ID NO: 8709 - DNA, 20 bp, Artificial
  20-mer unique DNA sequence
ggtggggcttatcgcgggac

SEQ ID NO: 8710 - DNA, 20 bp, Artificial
  20-mer unique DNA sequence
tgaagtggcgggagcgtagc

SEQ ID NO: 8711 - DNA, 20 bp, Artificial
  20-mer unique DNA sequence
aggtcgggcagtgggtttcg

SEQ ID NO: 8712 - DNA, 20 bp, Artificial
  20-mer unique DNA sequence
gagacaccgagcccccaagg

SEQ ID NO: 8713 - DNA, 20 bp, Artificial
  20-mer unique DNA sequence
gcgtgcatcgggtcacagtt

SEQ ID NO: 8714 - DNA, 20 bp, Artificial
  20-mer unique DNA sequence
ttcgctactcgggggcatcc

SEQ ID NO: 8715 - DNA, 20 bp, Artificial
  20-mer unique DNA sequence
tggcgtgggaggagtgctga

SEQ ID NO: 8716 - DNA, 20 bp, Artificial
  20-mer unique DNA sequence
gggcggtgtcgtaagtgcgg

SEQ ID NO: 8717 - DNA, 20 bp, Artificial
  20-mer unique DNA sequence
gcccagcctatgctagacac

SEQ ID NO: 8718 - DNA, 20 bp, Artificial
  20-mer unique DNA sequence
ttacgggaaggtggatgggg

SEQ ID NO: 8719 - DNA, 20 bp, Artificial
  20-mer unique DNA sequence
tgccgttcctttctcgccct

SEQ ID NO: 8720 - DNA, 20 bp, Artificial
  20-mer unique DNA sequence
tgcaggacaggggtagcgcc

SEQ ID NO: 8721 - DNA, 20 bp, Artificial
  20-mer unique DNA sequence
gcggtttgtaggtcgggtcc

SEQ ID NO: 8722 - DNA, 20 bp, Artificial
  20-mer unique DNA sequence
tggcagcgagccatgtgtga

SEQ ID NO: 8723 - DNA, 20 bp, Artificial
  20-mer unique DNA sequence
ggcaacgggtgttaccgagt

SEQ ID NO: 8724 - DNA, 20 bp, Artificial
  20-mer unique DNA sequence
gggttcccccggatgatggt

SEQ ID NO: 8725 - DNA, 20 bp, Artificial
  20-mer unique DNA sequence
gggctcgcgtgtttcgggat

SEQ ID NO: 8726 - DNA, 20 bp, Artificial
  20-mer unique DNA sequence
cggggcgagtttggcagcta

SEQ ID NO: 8727 - DNA, 20 bp, Artificial
  20-mer unique DNA sequence
ggtcggaacgcgtaggcatg

SEQ ID NO: 8728 - DNA, 20 bp, Artificial
  20-mer unique DNA sequence
tagccctcgtccaatgccgc

SEQ ID NO: 8729 - DNA, 20 bp, Artificial
  20-mer unique DNA sequence
ggaacaacaggtacgcccgc

SEQ ID NO: 8730 - DNA, 20 bp, Artificial
  20-mer unique DNA sequence
tcagtccgcactggtaccgt

SEQ ID NO: 8731 - DNA, 20 bp, Artificial
  20-mer unique DNA sequence
agacgctgaggcgaagtcgt

SEQ ID NO: 8732 - DNA, 20 bp, Artificial
  20-mer unique DNA sequence
ccgctaccgagtcggcaaat

SEQ ID NO: 8733 - DNA, 20 bp, Artificial
  20-mer unique DNA sequence
cgggctcgattaggcactca

SEQ ID NO: 8734 - DNA, 20 bp, Artificial
  20-mer unique DNA sequence
agtgcgcagcctatcgacca

SEQ ID NO: 8735 - DNA, 20 bp, Artificial
  20-mer unique DNA sequence
tcatgccgcagtcctggtca

SEQ ID NO: 8736 - DNA, 20 bp, Artificial
  20-mer unique DNA sequence
atagggtccggcgctcaagg

SEQ ID NO: 8737 - DNA, 20 bp, Artificial
  20-mer unique DNA sequence
ggaagccccatacgcccagc

SEQ ID NO: 8738 - DNA, 20 bp, Artificial
  20-mer unique DNA sequence
atgcgtcgagcagtgtggtt

SEQ ID NO: 8739 - DNA, 20 bp, Artificial
  20-mer unique DNA sequence
atgccccctttccaacgctt

SEQ ID NO: 8740 - DNA, 20 bp, Artificial
  20-mer unique DNA sequence
gctccgcggcctacacccat

SEQ ID NO: 8741 - DNA, 20 bp, Artificial
  20-mer unique DNA sequence
tgagaaggaccagccgccga

SEQ ID NO: 8742 - DNA, 20 bp, Artificial
  20-mer unique DNA sequence
ggcgttgctttgggttggaa

SEQ ID NO: 8743 - DNA, 20 bp, Artificial
  20-mer unique DNA sequence
tccctgcctaccccctgctc

SEQ ID NO: 8744 - DNA, 20 bp, Artificial
  20-mer unique DNA sequence
agggttggccgaatggggac

SEQ ID NO: 8745 - DNA, 20 bp, Artificial
  20-mer unique DNA sequence
gcgcccgatatattgccgtt

SEQ ID NO: 8746 - DNA, 20 bp, Artificial
  20-mer unique DNA sequence
ggtggtgggtggcgtctgtg

SEQ ID NO: 8747 - DNA, 20 bp, Artificial
  20-mer unique DNA sequence
gaggttggggattgggcgtg

SEQ ID NO: 8748 - DNA, 20 bp, Artificial
  20-mer unique DNA sequence
catctgtcgcgctgaccaag

SEQ ID NO: 8749 - DNA, 20 bp, Artificial
  20-mer unique DNA sequence
actccgagtggctatgcacg

SEQ ID NO: 8750 - DNA, 20 bp, Artificial
  20-mer unique DNA sequence
ttcagggcgttcggtagggg

SEQ ID NO: 8751 - DNA, 20 bp, Artificial
  20-mer unique DNA sequence
tccgttcctccatacgcctt

SEQ ID NO: 8752 - DNA, 20 bp, Artificial
  20-mer unique DNA sequence
ttttacccggagccgctctt

SEQ ID NO: 8753 - DNA, 20 bp, Artificial
  20-mer unique DNA sequence
gccgctctgcgacatctagt

SEQ ID NO: 8754 - DNA, 20 bp, Artificial
  20-mer unique DNA sequence
tttccggtgacgccggttga

SEQ ID NO: 8755 - DNA, 20 bp, Artificial
  20-mer unique DNA sequence
acgtagcagcctggcgtgaa

SEQ ID NO: 8756 - DNA, 20 bp, Artificial
  20-mer unique DNA sequence
gccggggggaattctatgct

SEQ ID NO: 8757 - DNA, 20 bp, Artificial
  20-mer unique DNA sequence
ttgggataggtgcgtccgga

SEQ ID NO: 8758 - DNA, 20 bp, Artificial
  20-mer unique DNA sequence
cctctggggttcttcggcgc

SEQ ID NO: 8759 - DNA, 20 bp, Artificial
  20-mer unique DNA sequence
acccgatgcccaagccctat

SEQ ID NO: 8760 - DNA, 20 bp, Artificial
  20-mer unique DNA sequence
gccgtatgaggggtctcgtt

SEQ ID NO: 8761 - DNA, 20 bp, Artificial
  20-mer unique DNA sequence
tgtcttgcaggtccgccatc

SEQ ID NO: 8762 - DNA, 20 bp, Artificial
  20-mer unique DNA sequence
tgttccgaggggtttgcgtg

SEQ ID NO: 8763 - DNA, 20 bp, Artificial
  20-mer unique DNA sequence
tgccgaaacccctggaaggt

SEQ ID NO: 8764 - DNA, 20 bp, Artificial
  20-mer unique DNA sequence
gccttccctagggccacatt

SEQ ID NO: 8765 - DNA, 20 bp, Artificial
  20-mer unique DNA sequence
ttgcagagcctgcgatgagt

SEQ ID NO: 8766 - DNA, 20 bp, Artificial
  20-mer unique DNA sequence
ttcacccgtttccgtccgtt

SEQ ID NO: 8767 - DNA, 20 bp, Artificial
  20-mer unique DNA sequence
gcaatgtacccgcgcccaag

SEQ ID NO: 8768 - DNA, 20 bp, Artificial
  20-mer unique DNA sequence
gctgcacgcgtgtaagtcag

SEQ ID NO: 8769 - DNA, 20 bp, Artificial
  20-mer unique DNA sequence
acacaggggccctcgatgaa

SEQ ID NO: 8770 - DNA, 20 bp, Artificial
  20-mer unique DNA sequence
tccaagaagtagcccccccg

SEQ ID NO: 8771 - DNA, 20 bp, Artificial
  20-mer unique DNA sequence
ggggggacaaggtgcggaat

SEQ ID NO: 8772 - DNA, 20 bp, Artificial
  20-mer unique DNA sequence
aatgcgtccacgggaacctc

SEQ ID NO: 8773 - DNA, 20 bp, Artificial
  20-mer unique DNA sequence
ggcaacttcccgtaggacga

SEQ ID NO: 8774 - DNA, 20 bp, Artificial
  20-mer unique DNA sequence
cgcgcaccggtaagcaaccg

SEQ ID NO: 8775 - DNA, 20 bp, Artificial
  20-mer unique DNA sequence
cagaaagcacacggcgacgg

SEQ ID NO: 8776 - DNA, 20 bp, Artificial
  20-mer unique DNA sequence
cggcctcggtttggtggtgt

SEQ ID NO: 8777 - DNA, 20 bp, Artificial
  20-mer unique DNA sequence
gcggtaataagggcgggggt

SEQ ID NO: 8778 - DNA, 20 bp, Artificial
  20-mer unique DNA sequence
atagcctcgggcgtcgatga

SEQ ID NO: 8779 - DNA, 20 bp, Artificial
  20-mer unique DNA sequence
gtggtccaaggcgtcgatga

SEQ ID NO: 8780 - DNA, 20 bp, Artificial
  20-mer unique DNA sequence
gaaacctcacggggtgcctg

SEQ ID NO: 8781 - DNA, 20 bp, Artificial
  20-mer unique DNA sequence
ggggaaaggtgtcgcatgcg

SEQ ID NO: 8782 - DNA, 20 bp, Artificial
  20-mer unique DNA sequence
gcgctcgttaatgctcacga

SEQ ID NO: 8783 - DNA, 20 bp, Artificial
  20-mer unique DNA sequence
acgcagagaggcgcagaagc

SEQ ID NO: 8784 - DNA, 20 bp, Artificial
  20-mer unique DNA sequence
tgctcgtattgccttggtcc

SEQ ID NO: 8785 - DNA, 20 bp, Artificial
  20-mer unique DNA sequence
ggcgtgggcagagagaggtg

SEQ ID NO: 8786 - DNA, 20 bp, Artificial
  20-mer unique DNA sequence
ccaaaagggcatggtccacg

SEQ ID NO: 8787 - DNA, 20 bp, Artificial
  20-mer unique DNA sequence
cgggacggagagggctgact

SEQ ID NO: 8788 - DNA, 20 bp, Artificial
  20-mer unique DNA sequence
tgagcctccgagtggtgtgt

SEQ ID NO: 8789 - DNA, 20 bp, Artificial
  20-mer unique DNA sequence
acgtgactctagcgcagcga

SEQ ID NO: 8790 - DNA, 20 bp, Artificial
  20-mer unique DNA sequence
cattacgtagggacggcttg

SEQ ID NO: 8791 - DNA, 20 bp, Artificial
  20-mer unique DNA sequence
acatagtgcaggtccgtcgc

SEQ ID NO: 8792 - DNA, 20 bp, Artificial
  20-mer unique DNA sequence
ctccacctcccgccttctcc

SEQ ID NO: 8793 - DNA, 20 bp, Artificial
  20-mer unique DNA sequence
ggacgtcacctgaccgtctt

SEQ ID NO: 8794 - DNA, 20 bp, Artificial
  20-mer unique DNA sequence
agttgtagggtcggggggag

SEQ ID NO: 8795 - DNA, 20 bp, Artificial
  20-mer unique DNA sequence
atgaggggttcgcgtgtggg

SEQ ID NO: 8796 - DNA, 20 bp, Artificial
  20-mer unique DNA sequence
ccccggctctggtcttctcc

SEQ ID NO: 8797 - DNA, 20 bp, Artificial
  20-mer unique DNA sequence
ggccgcaccaacatcttccg

SEQ ID NO: 8798 - DNA, 20 bp, Artificial
  20-mer unique DNA sequence
cgccgtatttccccagttcg

SEQ ID NO: 8799 - DNA, 20 bp, Artificial
  20-mer unique DNA sequence
cgtccgggctgacgtaactt

SEQ ID NO: 8800 - DNA, 20 bp, Artificial
  20-mer unique DNA sequence
gagtcggcgggctttcaggt

SEQ ID NO: 8801 - DNA, 20 bp, Artificial
  20-mer unique DNA sequence
aggtgtgggtgttctggcgc

SEQ ID NO: 8802 - DNA, 20 bp, Artificial
  20-mer unique DNA sequence
cgccccctcgtcaacaccct

SEQ ID NO: 8803 - DNA, 20 bp, Artificial
  20-mer unique DNA sequence
ctcccctgttctcgcccacc

SEQ ID NO: 8804 - DNA, 20 bp, Artificial
  20-mer unique DNA sequence
ggaagtgggccgtaaagcga

SEQ ID NO: 8805 - DNA, 20 bp, Artificial
  20-mer unique DNA sequence
gcttgtgcaagccgatacgc

SEQ ID NO: 8806 - DNA, 20 bp, Artificial
  20-mer unique DNA sequence
atcacgccctcccacttcgt

SEQ ID NO: 8807 - DNA, 20 bp, Artificial
  20-mer unique DNA sequence
tttgcgtggttcgctgcgta

SEQ ID NO: 8808 - DNA, 20 bp, Artificial
  20-mer unique DNA sequence
tcgagtcgccttagacccgt

SEQ ID NO: 8809 - DNA, 20 bp, Artificial
  20-mer unique DNA sequence
accctatgcccccttcaccg

SEQ ID NO: 8810 - DNA, 20 bp, Artificial
  20-mer unique DNA sequence
ccagaccgcgagccgaagaa

SEQ ID NO: 8811 - DNA, 20 bp, Artificial
  20-mer unique DNA sequence
tggatcccgtgggccgtatt

SEQ ID NO: 8812 - DNA, 20 bp, Artificial
  20-mer unique DNA sequence
ggccggattagtgccaccta

SEQ ID NO: 8813 - DNA, 20 bp, Artificial
  20-mer unique DNA sequence
cggtgtacgtcgaaccgttg

SEQ ID NO: 8814 - DNA, 20 bp, Artificial
  20-mer unique DNA sequence
accgtactcgcgagagtgga

SEQ ID NO: 8815 - DNA, 20 bp, Artificial
  20-mer unique DNA sequence
tgccgtgaccttatgctggt

SEQ ID NO: 8816 - DNA, 20 bp, Artificial
  20-mer unique DNA sequence
aattggcccactacccgtcg

SEQ ID NO: 8817 - DNA, 20 bp, Artificial
  20-mer unique DNA sequence
gctgacctaaagacggcggg

SEQ ID NO: 8818 - DNA, 20 bp, Artificial
  20-mer unique DNA sequence
gacgttaaatggcgagcgcg

SEQ ID NO: 8819 - DNA, 20 bp, Artificial
  20-mer unique DNA sequence
gcgtcgcggttatcgtgctt

SEQ ID NO: 8820 - DNA, 20 bp, Artificial
  20-mer unique DNA sequence
ataggcccggaactcgcact

SEQ ID NO: 8821 - DNA, 20 bp, Artificial
  20-mer unique DNA sequence
tcatcgggaactccactgcg

SEQ ID NO: 8822 - DNA, 20 bp, Artificial
  20-mer unique DNA sequence
tggagcccggacaggactaa

SEQ ID NO: 8823 - DNA, 20 bp, Artificial
  20-mer unique DNA sequence
actacacggaccagcgggaa

SEQ ID NO: 8824 - DNA, 20 bp, Artificial
  20-mer unique DNA sequence
ttgtccctcattccccgcca

SEQ ID NO: 8825 - DNA, 20 bp, Artificial
  20-mer unique DNA sequence
ccagcggcgttgctttcaga

SEQ ID NO: 8826 - DNA, 20 bp, Artificial
  20-mer unique DNA sequence
gagcacggggtatccaatgc

SEQ ID NO: 8827 - DNA, 20 bp, Artificial
  20-mer unique DNA sequence
tcgttgcgcccttgttcacc

SEQ ID NO: 8828 - DNA, 20 bp, Artificial
  20-mer unique DNA sequence
ggtcatggtagggtggcggg

SEQ ID NO: 8829 - DNA, 20 bp, Artificial
  20-mer unique DNA sequence
gttgcactgtactcgccggc

SEQ ID NO: 8830 - DNA, 20 bp, Artificial
  20-mer unique DNA sequence
gtcttctggaggtgcgggga

SEQ ID NO: 8831 - DNA, 20 bp, Artificial
  20-mer unique DNA sequence
cgaggaaacggtgatcgggt

SEQ ID NO: 8832 - DNA, 20 bp, Artificial
  20-mer unique DNA sequence
tgaagcccgggtgataccga

SEQ ID NO: 8833 - DNA, 20 bp, Artificial
  20-mer unique DNA sequence
tgctgcctggacgcctgtta

SEQ ID NO: 8834 - DNA, 20 bp, Artificial
  20-mer unique DNA sequence
agagtgccgagcactgagac

SEQ ID NO: 8835 - DNA, 20 bp, Artificial
  20-mer unique DNA sequence
agtccctagctacaggcgga

SEQ ID NO: 8836 - DNA, 20 bp, Artificial
  20-mer unique DNA sequence
ccagcgtgtcgtggacagat

SEQ ID NO: 8837 - DNA, 20 bp, Artificial
  20-mer unique DNA sequence
actctgcgagtccgtgaagc

SEQ ID NO: 8838 - DNA, 20 bp, Artificial
  20-mer unique DNA sequence
gccaagggtggggcgaaatc

SEQ ID NO: 8839 - DNA, 20 bp, Artificial
  20-mer unique DNA sequence
ggggcgggagtcaataggca

SEQ ID NO: 8840 - DNA, 20 bp, Artificial
  20-mer unique DNA sequence
acttccggcacgaccgatag

SEQ ID NO: 8841 - DNA, 20 bp, Artificial
  20-mer unique DNA sequence
acccggttagcctcgcatac

SEQ ID NO: 8842 - DNA, 20 bp, Artificial
  20-mer unique DNA sequence
catcaagcagggcgaggcca

SEQ ID NO: 8843 - DNA, 20 bp, Artificial
  20-mer unique DNA sequence
ccacctgtcccaaccagcca

SEQ ID NO: 8844 - DNA, 20 bp, Artificial
  20-mer unique DNA sequence
tggtagcctcgtacaggcga

SEQ ID NO: 8845 - DNA, 20 bp, Artificial
  20-mer unique DNA sequence
taggacaaggccgcggggac

SEQ ID NO: 8846 - DNA, 20 bp, Artificial
  20-mer unique DNA sequence
gtgttgagggaagcgaggcg

SEQ ID NO: 8847 - DNA, 20 bp, Artificial
  20-mer unique DNA sequence
actgacgggagggcatacgg

SEQ ID NO: 8848 - DNA, 20 bp, Artificial
  20-mer unique DNA sequence
cccgcaagaaaatgtgccct

SEQ ID NO: 8849 - DNA, 20 bp, Artificial
  20-mer unique DNA sequence
accacaccccgttccctcgt

SEQ ID NO: 8850 - DNA, 20 bp, Artificial
  20-mer unique DNA sequence
aggactccgctagtgccctt

SEQ ID NO: 8851 - DNA, 20 bp, Artificial
  20-mer unique DNA sequence
aacacagctcggagcctcac

SEQ ID NO: 8852 - DNA, 20 bp, Artificial
  20-mer unique DNA sequence
tgacctcgtgggacgactgt

SEQ ID NO: 8853 - DNA, 20 bp, Artificial
  20-mer unique DNA sequence
cgctcgacgctctgtgacaa

SEQ ID NO: 8854 - DNA, 20 bp, Artificial
  20-mer unique DNA sequence
tgttaagtgccacggtcgct

SEQ ID NO: 8855 - DNA, 20 bp, Artificial
  20-mer unique DNA sequence
aggtcggacaccctcacgta

SEQ ID NO: 8856 - DNA, 20 bp, Artificial
  20-mer unique DNA sequence
tttggggggagttggcgatg

SEQ ID NO: 8857 - DNA, 20 bp, Artificial
  20-mer unique DNA sequence
cccccctgagaacgcaccaa

SEQ ID NO: 8858 - DNA, 20 bp, Artificial
  20-mer unique DNA sequence
tggttaagccggtcgggggt

SEQ ID NO: 8859 - DNA, 20 bp, Artificial
  20-mer unique DNA sequence
gcgcccaatgaaagggtttg

SEQ ID NO: 8860 - DNA, 20 bp, Artificial
  20-mer unique DNA sequence
ttggatgccgtgtgacgaga

SEQ ID NO: 8861 - DNA, 20 bp, Artificial
  20-mer unique DNA sequence
agggcacgccttagtacacc

SEQ ID NO: 8862 - DNA, 20 bp, Artificial
  20-mer unique DNA sequence
atccaccggtccgggttagt

SEQ ID NO: 8863 - DNA, 20 bp, Artificial
  20-mer unique DNA sequence
gggcggtatcgtaactgcgg

SEQ ID NO: 8864 - DNA, 20 bp, Artificial
  20-mer unique DNA sequence
gtccggcgggtagagtggca

SEQ ID NO: 8865 - DNA, 20 bp, Artificial
  20-mer unique DNA sequence
cgttggtgataccggagggg

SEQ ID NO: 8866 - DNA, 20 bp, Artificial
  20-mer unique DNA sequence
tggcttgccacggggatctt

SEQ ID NO: 8867 - DNA, 20 bp, Artificial
  20-mer unique DNA sequence
tttcgggctgtaagtgcccc

SEQ ID NO: 8868 - DNA, 20 bp, Artificial
  20-mer unique DNA sequence
taatacctttcgccgcccca

SEQ ID NO: 8869 - DNA, 20 bp, Artificial
  20-mer unique DNA sequence
gcatgctgtcgtgttggcct

SEQ ID NO: 8870 - DNA, 20 bp, Artificial
  20-mer unique DNA sequence
ctgctgcggatggggttctg

SEQ ID NO: 8871 - DNA, 20 bp, Artificial
  20-mer unique DNA sequence
tggcgatggctttgcaggta

SEQ ID NO: 8872 - DNA, 20 bp, Artificial
  20-mer unique DNA sequence
agtgggagttggcggagcat

SEQ ID NO: 8873 - DNA, 20 bp, Artificial
  20-mer unique DNA sequence
aagcctcaagcccaacgcac

SEQ ID NO: 8874 - DNA, 20 bp, Artificial
  20-mer unique DNA sequence
aatccctgtccccccacgat

SEQ ID NO: 8875 - DNA, 20 bp, Artificial
  20-mer unique DNA sequence
atggacgggtttgagggggc

SEQ ID NO: 8876 - DNA, 20 bp, Artificial
  20-mer unique DNA sequence
gacaagtcgcacttgcaccc

SEQ ID NO: 8877 - DNA, 20 bp, Artificial
  20-mer unique DNA sequence
atctgccgacctacggaacc

SEQ ID NO: 8878 - DNA, 20 bp, Artificial
  20-mer unique DNA sequence
tgggtgcccagtaccgtgtt

SEQ ID NO: 8879 - DNA, 20 bp, Artificial
  20-mer unique DNA sequence
tggaggtcgacggaaactcg

SEQ ID NO: 8880 - DNA, 20 bp, Artificial
  20-mer unique DNA sequence
gtggcaccgaccggttacaa

SEQ ID NO: 8881 - DNA, 20 bp, Artificial
  20-mer unique DNA sequence
taacggatgagatccgcccg

SEQ ID NO: 8882 - DNA, 20 bp, Artificial
  20-mer unique DNA sequence
cgccgtaaacccccactttc

SEQ ID NO: 8883 - DNA, 20 bp, Artificial
  20-mer unique DNA sequence
agcaacccctgccccacaga

SEQ ID NO: 8884 - DNA, 20 bp, Artificial
  20-mer unique DNA sequence
agggcgacgggtaggatggt

SEQ ID NO: 8885 - DNA, 20 bp, Artificial
  20-mer unique DNA sequence
ggggattcggtgtcgttgga

SEQ ID NO: 8886 - DNA, 20 bp, Artificial
  20-mer unique DNA sequence
agtgtgcatgggcactgtct

SEQ ID NO: 8887 - DNA, 20 bp, Artificial
  20-mer unique DNA sequence
aaccctcttcgcgtccggct

SEQ ID NO: 8888 - DNA, 20 bp, Artificial
  20-mer unique DNA sequence
accaaaagccccctagcgcc

SEQ ID NO: 8889 - DNA, 20 bp, Artificial
  20-mer unique DNA sequence
agtcgcgacacgctgactct

SEQ ID NO: 8890 - DNA, 20 bp, Artificial
  20-mer unique DNA sequence
tgtcaaaaccgggtcaacct

SEQ ID NO: 8891 - DNA, 20 bp, Artificial
  20-mer unique DNA sequence
gcaatccgcccgaccactat

SEQ ID NO: 8892 - DNA, 20 bp, Artificial
  20-mer unique DNA sequence
gtaggcgggcatttggacga

SEQ ID NO: 8893 - DNA, 20 bp, Artificial
  20-mer unique DNA sequence
gcaacttcgggaaagcggac

SEQ ID NO: 8894 - DNA, 20 bp, Artificial
  20-mer unique DNA sequence
tgagagcgcacggtgcatta

SEQ ID NO: 8895 - DNA, 20 bp, Artificial
  20-mer unique DNA sequence
cgccgtgggtgatccgaaag

SEQ ID NO: 8896 - DNA, 20 bp, Artificial
  20-mer unique DNA sequence
gccggcagcagaaaggtagg

SEQ ID NO: 8897 - DNA, 20 bp, Artificial
  20-mer unique DNA sequence
tggacgtgcgccgaaagttg

SEQ ID NO: 8898 - DNA, 20 bp, Artificial
  20-mer unique DNA sequence
agtggaccgtacggcgattc

SEQ ID NO: 8899 - DNA, 20 bp, Artificial
  20-mer unique DNA sequence
tgtcacagggacccaggcat

SEQ ID NO: 8900 - DNA, 20 bp, Artificial
  20-mer unique DNA sequence
tttctgcccactaaggccgg

SEQ ID NO: 8901 - DNA, 20 bp, Artificial
  20-mer unique DNA sequence
gtcggagcggatcgcagttc

SEQ ID NO: 8902 - DNA, 20 bp, Artificial
  20-mer unique DNA sequence
agtagcccctgacttgacgc

SEQ ID NO: 8903 - DNA, 20 bp, Artificial
  20-mer unique DNA sequence
gacacagtcggctccgcaat

SEQ ID NO: 8904 - DNA, 20 bp, Artificial
  20-mer unique DNA sequence
cgcgggccttaacggagatg

SEQ ID NO: 8905 - DNA, 20 bp, Artificial
  20-mer unique DNA sequence
acttgcccgttccacccagc

SEQ ID NO: 8906 - DNA, 20 bp, Artificial
  20-mer unique DNA sequence
gtccctaagaacccccgcga

SEQ ID NO: 8907 - DNA, 20 bp, Artificial
  20-mer unique DNA sequence
cgatagggcaacgggggatg

SEQ ID NO: 8908 - DNA, 20 bp, Artificial
  20-mer unique DNA sequence
agggaggtggcgcttaggga

SEQ ID NO: 8909 - DNA, 20 bp, Artificial
  20-mer unique DNA sequence
caaacgtgggtgcaggctcg

SEQ ID NO: 8910 - DNA, 20 bp, Artificial
  20-mer unique DNA sequence
caacggcacagcaaacccca

SEQ ID NO: 8911 - DNA, 20 bp, Artificial
  20-mer unique DNA sequence
tgcctgtccctcgcctgatt

SEQ ID NO: 8912 - DNA, 20 bp, Artificial
  20-mer unique DNA sequence
tgtggatggcgcagttgggt

SEQ ID NO: 8913 - DNA, 20 bp, Artificial
  20-mer unique DNA sequence
ccgccttctcgctgcttgtc

SEQ ID NO: 8914 - DNA, 20 bp, Artificial
  20-mer unique DNA sequence
aagggcgaacgtcgcagact

SEQ ID NO: 8915 - DNA, 20 bp, Artificial
  20-mer unique DNA sequence
cgaggtcacgttaagcccct

SEQ ID NO: 8916 - DNA, 20 bp, Artificial
  20-mer unique DNA sequence
gcagcaagatcgcgtacggt

SEQ ID NO: 8917 - DNA, 20 bp, Artificial
  20-mer unique DNA sequence
gctgatctcacgcgactcca

SEQ ID NO: 8918 - DNA, 20 bp, Artificial
  20-mer unique DNA sequence
gtacaactgccggcctgcga

SEQ ID NO: 8919 - DNA, 20 bp, Artificial
  20-mer unique DNA sequence
gccggtaaagccatcgccac

SEQ ID NO: 8920 - DNA, 20 bp, Artificial
  20-mer unique DNA sequence
ggggggcgagtgaggtgttg

SEQ ID NO: 8921 - DNA, 20 bp, Artificial
  20-mer unique DNA sequence
ttccaagctactcgcgcccc

SEQ ID NO: 8922 - DNA, 20 bp, Artificial
  20-mer unique DNA sequence
gtagcggcccttttcggtga

SEQ ID NO: 8923 - DNA, 20 bp, Artificial
  20-mer unique DNA sequence
ctggcggggtgttggtggac

SEQ ID NO: 8924 - DNA, 20 bp, Artificial
  20-mer unique DNA sequence
cgtttcgccgttttcagcag

SEQ ID NO: 8925 - DNA, 20 bp, Artificial
  20-mer unique DNA sequence
ggcgatttcctttccttgcg

SEQ ID NO: 8926 - DNA, 20 bp, Artificial
  20-mer unique DNA sequence
aaacttttcggaacgccggg

SEQ ID NO: 8927 - DNA, 20 bp, Artificial
  20-mer unique DNA sequence
ctttatggggccggggttgc

SEQ ID NO: 8928 - DNA, 20 bp, Artificial
  20-mer unique DNA sequence
ttaaaccctcgcgcacacca

SEQ ID NO: 8929 - DNA, 20 bp, Artificial
  20-mer unique DNA sequence
cgtcgctacttgttcccccc

SEQ ID NO: 8930 - DNA, 20 bp, Artificial
  20-mer unique DNA sequence
tcatcgggggaagcacaggc

SEQ ID NO: 8931 - DNA, 20 bp, Artificial
  20-mer unique DNA sequence
acgtcgcggttatatcgggc

SEQ ID NO: 8932 - DNA, 20 bp, Artificial
  20-mer unique DNA sequence
ggctctttggcggttgtcgc

SEQ ID NO: 8933 - DNA, 20 bp, Artificial
  20-mer unique DNA sequence
ttccccaccccaacccgaat

SEQ ID NO: 8934 - DNA, 20 bp, Artificial
  20-mer unique DNA sequence
aaccccgttcgcagacgatc

SEQ ID NO: 8935 - DNA, 20 bp, Artificial
  20-mer unique DNA sequence
ggagcgtgtcaacaggggga

SEQ ID NO: 8936 - DNA, 20 bp, Artificial
  20-mer unique DNA sequence
ggccccttgcgtgttagctg

SEQ ID NO: 8937 - DNA, 20 bp, Artificial
  20-mer unique DNA sequence
gtcaatgcaatggcggtggg

SEQ ID NO: 8938 - DNA, 20 bp, Artificial
  20-mer unique DNA sequence
ctgcgtggcagtcccaaatg

SEQ ID NO: 8939 - DNA, 20 bp, Artificial
  20-mer unique DNA sequence
agatctacgcggtgacgcga

SEQ ID NO: 8940 - DNA, 20 bp, Artificial
  20-mer unique DNA sequence
cacgagccccgcacatacaa

SEQ ID NO: 8941 - DNA, 20 bp, Artificial
  20-mer unique DNA sequence
cagatcgcggtttgccttca

SEQ ID NO: 8942 - DNA, 20 bp, Artificial
  20-mer unique DNA sequence
taacccccgccaccaagaca

SEQ ID NO: 8943 - DNA, 20 bp, Artificial
  20-mer unique DNA sequence
acacacgaacccgcacaacc

SEQ ID NO: 8944 - DNA, 20 bp, Artificial
  20-mer unique DNA sequence
aacctttctgtgacggcggg

SEQ ID NO: 8945 - DNA, 20 bp, Artificial
  20-mer unique DNA sequence
accgcatacgccttccctca

SEQ ID NO: 8946 - DNA, 20 bp, Artificial
  20-mer unique DNA sequence
atccaagggtctcaatcgca

SEQ ID NO: 8947 - DNA, 20 bp, Artificial
  20-mer unique DNA sequence
tcacccttctttggctcgca

SEQ ID NO: 8948 - DNA, 20 bp, Artificial
  20-mer unique DNA sequence
ctacggccggttggattggg

SEQ ID NO: 8949 - DNA, 20 bp, Artificial
  20-mer unique DNA sequence
ccggcagaccccacgacaac

SEQ ID NO: 8950 - DNA, 20 bp, Artificial
  20-mer unique DNA sequence
cgcgtctcatcgatgccctt

SEQ ID NO: 8951 - DNA, 20 bp, Artificial
  20-mer unique DNA sequence
ccgatcaggggcgagggttt

SEQ ID NO: 8952 - DNA, 20 bp, Artificial
  20-mer unique DNA sequence
cgagacgcacccaacatccc

SEQ ID NO: 8953 - DNA, 20 bp, Artificial
  20-mer unique DNA sequence
tctttgatggggggcaagcg

SEQ ID NO: 8954 - DNA, 20 bp, Artificial
  20-mer unique DNA sequence
cagacctgttgaacgccgca

SEQ ID NO: 8955 - DNA, 20 bp, Artificial
  20-mer unique DNA sequence
gggccatctcgaacttgcac

SEQ ID NO: 8956 - DNA, 20 bp, Artificial
  20-mer unique DNA sequence
tctgttaagggcggcatggg

SEQ ID NO: 8957 - DNA, 20 bp, Artificial
  20-mer unique DNA sequence
ggaaagagagcggcacgggt

SEQ ID NO: 8958 - DNA, 20 bp, Artificial
  20-mer unique DNA sequence
aacgggcgggatgaggtggt

SEQ ID NO: 8959 - DNA, 20 bp, Artificial
  20-mer unique DNA sequence
cttcattcccccttcccgcg

SEQ ID NO: 8960 - DNA, 20 bp, Artificial
  20-mer unique DNA sequence
ttcaatacggcgggacacga

SEQ ID NO: 8961 - DNA, 20 bp, Artificial
  20-mer unique DNA sequence
cgggcaaggtacccccaact

SEQ ID NO: 8962 - DNA, 20 bp, Artificial
  20-mer unique DNA sequence
acaagccgccagagcctcaa

SEQ ID NO: 8963 - DNA, 20 bp, Artificial
  20-mer unique DNA sequence
aatggaaggtgcctgcgtga

SEQ ID NO: 8964 - DNA, 20 bp, Artificial
  20-mer unique DNA sequence
ctcacagttcgcggttgtcc

SEQ ID NO: 8965 - DNA, 20 bp, Artificial
  20-mer unique DNA sequence
accggccaattccttcctcc

SEQ ID NO: 8966 - DNA, 20 bp, Artificial
  20-mer unique DNA sequence
gcggctgggttagtgtggcg

SEQ ID NO: 8967 - DNA, 20 bp, Artificial
  20-mer unique DNA sequence
agccccgcccacccagtcta

SEQ ID NO: 8968 - DNA, 20 bp, Artificial
  20-mer unique DNA sequence
ccttatcgacgttcccgcca

SEQ ID NO: 8969 - DNA, 20 bp, Artificial
  20-mer unique DNA sequence
ccctcgctcctgtctcggct

SEQ ID NO: 8970 - DNA, 20 bp, Artificial
  20-mer unique DNA sequence
taagggccggggatcgtctc

SEQ ID NO: 8971 - DNA, 20 bp, Artificial
  20-mer unique DNA sequence
tatcgggcgggcatttcttg

SEQ ID NO: 8972 - DNA, 20 bp, Artificial
  20-mer unique DNA sequence
agcgcaaccccagcaaaatc

SEQ ID NO: 8973 - DNA, 20 bp, Artificial
  20-mer unique DNA sequence
actaggagcacatggggcgg

SEQ ID NO: 8974 - DNA, 20 bp, Artificial
  20-mer unique DNA sequence
cgccggccgctaggttacaa

SEQ ID NO: 8975 - DNA, 20 bp, Artificial
  20-mer unique DNA sequence
ccgatcacagcacaagccga

SEQ ID NO: 8976 - DNA, 20 bp, Artificial
  20-mer unique DNA sequence
tcctcgcctccaccaccata

SEQ ID NO: 8977 - DNA, 20 bp, Artificial
  20-mer unique DNA sequence
cagtttcacgcagagggggg

SEQ ID NO: 8978 - DNA, 20 bp, Artificial
  20-mer unique DNA sequence
ttcaagcaaagcgcagcacc

SEQ ID NO: 8979 - DNA, 20 bp, Artificial
  20-mer unique DNA sequence
ggcctcggggtggtaagcgt

SEQ ID NO: 8980 - DNA, 20 bp, Artificial
  20-mer unique DNA sequence
gtgagggggggtccaaaggc

SEQ ID NO: 8981 - DNA, 20 bp, Artificial
  20-mer unique DNA sequence
aagggccaatcaggggggtt

SEQ ID NO: 8982 - DNA, 20 bp, Artificial
  20-mer unique DNA sequence
cgtccactcacaagcgggca

SEQ ID NO: 8983 - DNA, 20 bp, Artificial
  20-mer unique DNA sequence
tgattttgccacgtggggga

SEQ ID NO: 8984 - DNA, 20 bp, Artificial
  20-mer unique DNA sequence
tgcattgtgaaccccccgtc

SEQ ID NO: 8985 - DNA, 20 bp, Artificial
  20-mer unique DNA sequence
ctagctcccgcccccagttt

SEQ ID NO: 8986 - DNA, 20 bp, Artificial
  20-mer unique DNA sequence
ttggggagaagaccggatgg

SEQ ID NO: 8987 - DNA, 20 bp, Artificial
  20-mer unique DNA sequence
cgacgcctcacgaaatgcac

SEQ ID NO: 8988 - DNA, 20 bp, Artificial
  20-mer unique DNA sequence
catccatccccatcgcacaa

SEQ ID NO: 8989 - DNA, 20 bp, Artificial
  20-mer unique DNA sequence
tcaatccagtcccaggcgga

SEQ ID NO: 8990 - DNA, 20 bp, Artificial
  20-mer unique DNA sequence
tgccggtaactacgtgtcgg

SEQ ID NO: 8991 - DNA, 20 bp, Artificial
  20-mer unique DNA sequence
acaaagggaggcgaggtccg

SEQ ID NO: 8992 - DNA, 20 bp, Artificial
  20-mer unique DNA sequence
gcacaggcgagggggagcta

SEQ ID NO: 8993 - DNA, 20 bp, Artificial
  20-mer unique DNA sequence
gtctccgggcggtcttgctg

SEQ ID NO: 8994 - DNA, 20 bp, Artificial
  20-mer unique DNA sequence
cgcggcaaaaggacgatcaa

SEQ ID NO: 8995 - DNA, 20 bp, Artificial
  20-mer unique DNA sequence
agggcgtggggagctttgag

SEQ ID NO: 8996 - DNA, 20 bp, Artificial
  20-mer unique DNA sequence
taggtgggaaatggacgggc

SEQ ID NO: 8997 - DNA, 20 bp, Artificial
  20-mer unique DNA sequence
tcaagagaacggccacccca

SEQ ID NO: 8998 - DNA, 20 bp, Artificial
  20-mer unique DNA sequence
gtgggtaaaggctgcgaggg

SEQ ID NO: 8999 - DNA, 20 bp, Artificial
  20-mer unique DNA sequence
ctaatccgtgccctcgcccc

SEQ ID NO: 9000 - DNA, 20 bp, Artificial
  20-mer unique DNA sequence
cccctccgcgtcccattcat

SEQ ID NO: 9001 - DNA, 20 bp, Artificial
  20-mer unique DNA sequence
cccgcccaaagtcctccaaa

SEQ ID NO: 9002 - DNA, 20 bp, Artificial
  20-mer unique DNA sequence
aacgaacggagggagcgtgg

SEQ ID NO: 9003 - DNA, 20 bp, Artificial
  20-mer unique DNA sequence
tcgttcttcccttcgtcccg

SEQ ID NO: 9004 - DNA, 20 bp, Artificial
  20-mer unique DNA sequence
gacggcgggttaggctcagg

SEQ ID NO: 9005 - DNA, 20 bp, Artificial
  20-mer unique DNA sequence
cggcaacaaaacccgcctaa

SEQ ID NO: 9006 - DNA, 20 bp, Artificial
  20-mer unique DNA sequence
tgaatgcccccgtccgtaag

SEQ ID NO: 9007 - DNA, 20 bp, Artificial
  20-mer unique DNA sequence
cgccctacccgccacatctc

SEQ ID NO: 9008 - DNA, 20 bp, Artificial
  20-mer unique DNA sequence
tgttcagtcgttggcagggg

SEQ ID NO: 9009 - DNA, 20 bp, Artificial
  20-mer unique DNA sequence
tccgtggtgggtgagaatgc

SEQ ID NO: 9010 - DNA, 20 bp, Artificial
  20-mer unique DNA sequence
tcgtcagtttggggcgtcct

SEQ ID NO: 9011 - DNA, 20 bp, Artificial
  20-mer unique DNA sequence
agccgggtctatgtggagca

SEQ ID NO: 9012 - DNA, 20 bp, Artificial
  20-mer unique DNA sequence
acaagccgttatcccgcccc

SEQ ID NO: 9013 - DNA, 20 bp, Artificial
  20-mer unique DNA sequence
agtttgtcggggcacgggta

SEQ ID NO: 9014 - DNA, 20 bp, Artificial
  20-mer unique DNA sequence
ttgcggtcgatgcggagtgt

SEQ ID NO: 9015 - DNA, 20 bp, Artificial
  20-mer unique DNA sequence
cggacacgacgaggacaggc

SEQ ID NO: 9016 - DNA, 20 bp, Artificial
  20-mer unique DNA sequence
ttaggatggtcgaggcgcgt

SEQ ID NO: 9017 - DNA, 20 bp, Artificial
  20-mer unique DNA sequence
aacgagggtgctggggaatg

SEQ ID NO: 9018 - DNA, 20 bp, Artificial
  20-mer unique DNA sequence
agggccgagcaagatgaacg

SEQ ID NO: 9019 - DNA, 20 bp, Artificial
  20-mer unique DNA sequence
tcgtccaccgccacagttcg

SEQ ID NO: 9020 - DNA, 20 bp, Artificial
  20-mer unique DNA sequence
gtcagggtcgggcaaaacgc

SEQ ID NO: 9021 - DNA, 20 bp, Artificial
  20-mer unique DNA sequence
tcctttaccgaccgcaccgt

SEQ ID NO: 9022 - DNA, 20 bp, Artificial
  20-mer unique DNA sequence
cttgtcctgccctgttgccg

SEQ ID NO: 9023 - DNA, 20 bp, Artificial
  20-mer unique DNA sequence
caacccgacccaaccacgtg

SEQ ID NO: 9024 - DNA, 20 bp, Artificial
  20-mer unique DNA sequence
atctcgccacacacccgtca

SEQ ID NO: 9025 - DNA, 20 bp, Artificial
  20-mer unique DNA sequence
ctaaaaccccccgcaccacg

SEQ ID NO: 9026 - DNA, 20 bp, Artificial
  20-mer unique DNA sequence
tgaacggctcatgccgcact

SEQ ID NO: 9027 - DNA, 20 bp, Artificial
  20-mer unique DNA sequence
acctcccgctagatgtgcga

SEQ ID NO: 9028 - DNA, 20 bp, Artificial
  20-mer unique DNA sequence
gctcgtggggaaggcgcatt

SEQ ID NO: 9029 - DNA, 20 bp, Artificial
  20-mer unique DNA sequence
ttgcgatgtcctgccgtgtt

SEQ ID NO: 9030 - DNA, 20 bp, Artificial
  20-mer unique DNA sequence
ctttcacaggcgagcgagca

SEQ ID NO: 9031 - DNA, 20 bp, Artificial
  20-mer unique DNA sequence
gcgggaggtgcggatgagaa

SEQ ID NO: 9032 - DNA, 20 bp, Artificial
  20-mer unique DNA sequence
atgccaacgaggacgggtgt

SEQ ID NO: 9033 - DNA, 20 bp, Artificial
  20-mer unique DNA sequence
cggcagggtgggcacagaag

SEQ ID NO: 9034 - DNA, 20 bp, Artificial
  20-mer unique DNA sequence
ccccgcttatcccattgccc

SEQ ID NO: 9035 - DNA, 20 bp, Artificial
  20-mer unique DNA sequence
ttcccctgccctgattgacc

SEQ ID NO: 9036 - DNA, 20 bp, Artificial
  20-mer unique DNA sequence
atcatgcgggacgaggcgac

SEQ ID NO: 9037 - DNA, 20 bp, Artificial
  20-mer unique DNA sequence
cctgtgcatgccccaacgtc

SEQ ID NO: 9038 - DNA, 20 bp, Artificial
  20-mer unique DNA sequence
tctgttcgaggtggagcccc

SEQ ID NO: 9039 - DNA, 20 bp, Artificial
  20-mer unique DNA sequence
ttcgttgccgctcgtggtga

SEQ ID NO: 9040 - DNA, 20 bp, Artificial
  20-mer unique DNA sequence
caagccctagcaactcccgc

SEQ ID NO: 9041 - DNA, 20 bp, Artificial
  20-mer unique DNA sequence
ccggagcgaaagaaaggtgc

SEQ ID NO: 9042 - DNA, 20 bp, Artificial
  20-mer unique DNA sequence
atctgtcggtgggttggcga

SEQ ID NO: 9043 - DNA, 20 bp, Artificial
  20-mer unique DNA sequence
agggggcatagggacagcgg

SEQ ID NO: 9044 - DNA, 20 bp, Artificial
  20-mer unique DNA sequence
cggccccatggataagctgc

SEQ ID NO: 9045 - DNA, 20 bp, Artificial
  20-mer unique DNA sequence
gctctctcccaatcaccggc

SEQ ID NO: 9046 - DNA, 20 bp, Artificial
  20-mer unique DNA sequence
tcgtcgttgcgtcctcctcc

SEQ ID NO: 9047 - DNA, 20 bp, Artificial
  20-mer unique DNA sequence
agaagccctgatgcccaacg

SEQ ID NO: 9048 - DNA, 20 bp, Artificial
  20-mer unique DNA sequence
ggtggccggggaatggtgat

SEQ ID NO: 9049 - DNA, 20 bp, Artificial
  20-mer unique DNA sequence
gcggtttcagccattccaca

SEQ ID NO: 9050 - DNA, 20 bp, Artificial
  20-mer unique DNA sequence
tttaggtgtcgcgggtagga

SEQ ID NO: 9051 - DNA, 20 bp, Artificial
  20-mer unique DNA sequence
tcgcgatctcgcggcaacta

SEQ ID NO: 9052 - DNA, 20 bp, Artificial
  20-mer unique DNA sequence
caaatcatggcaacggacgg

SEQ ID NO: 9053 - DNA, 20 bp, Artificial
  20-mer unique DNA sequence
atggccaagcaagtccggaa

SEQ ID NO: 9054 - DNA, 20 bp, Artificial
  20-mer unique DNA sequence
ctcactcacagcaaccgggc

SEQ ID NO: 9055 - DNA, 20 bp, Artificial
  20-mer unique DNA sequence
gttcatacgggggcggaggg

SEQ ID NO: 9056 - DNA, 20 bp, Artificial
  20-mer unique DNA sequence
tccatccatcacccagcccg

SEQ ID NO: 9057 - DNA, 20 bp, Artificial
  20-mer unique DNA sequence
tttccctgcttgctcccgtg

SEQ ID NO: 9058 - DNA, 20 bp, Artificial
  20-mer unique DNA sequence
cttagaccgctgccttccgc

SEQ ID NO: 9059 - DNA, 20 bp, Artificial
  20-mer unique DNA sequence
tgacttaggacccgcgcgtg

SEQ ID NO: 9060 - DNA, 20 bp, Artificial
  20-mer unique DNA sequence
cctcgccgtcgtcctcaacc

SEQ ID NO: 9061 - DNA, 20 bp, Artificial
  20-mer unique DNA sequence
gtcctttcccacctcggcct

SEQ ID NO: 9062 - DNA, 20 bp, Artificial
  20-mer unique DNA sequence
ccgcacgaacaaccccaaca

SEQ ID NO: 9063 - DNA, 20 bp, Artificial
  20-mer unique DNA sequence
tgaccgggtctagcttccgt

SEQ ID NO: 9064 - DNA, 20 bp, Artificial
  20-mer unique DNA sequence
atccgacgcccacaactccg

SEQ ID NO: 9065 - DNA, 20 bp, Artificial
  20-mer unique DNA sequence
ggaagggggtatgggcgtgt

SEQ ID NO: 9066 - DNA, 20 bp, Artificial
  20-mer unique DNA sequence
ggcagcaagggctacaagcg

SEQ ID NO: 9067 - DNA, 20 bp, Artificial
  20-mer unique DNA sequence
cccaaagcccccgaagaaag

SEQ ID NO: 9068 - DNA, 20 bp, Artificial
  20-mer unique DNA sequence
ccatcatgcggcgtcgatga

SEQ ID NO: 9069 - DNA, 20 bp, Artificial
  20-mer unique DNA sequence
tgctgagctgcgctgtacaa

SEQ ID NO: 9070 - DNA, 20 bp, Artificial
  20-mer unique DNA sequence
tcaacacgcaatagggggcc

SEQ ID NO: 9071 - DNA, 20 bp, Artificial
  20-mer unique DNA sequence
ctggggccgttgctggattt

SEQ ID NO: 9072 - DNA, 20 bp, Artificial
  20-mer unique DNA sequence
cgccggcaacgctacattaa

SEQ ID NO: 9073 - DNA, 20 bp, Artificial
  20-mer unique DNA sequence
tgttgcgctgtgggacctcg

SEQ ID NO: 9074 - DNA, 20 bp, Artificial
  20-mer unique DNA sequence
tcgcttttcgcctacccccc

SEQ ID NO: 9075 - DNA, 20 bp, Artificial
  20-mer unique DNA sequence
tggaacaaaggcgggagccc

SEQ ID NO: 9076 - DNA, 20 bp, Artificial
  20-mer unique DNA sequence
ggtccagcgtcgtttccagg

SEQ ID NO: 9077 - DNA, 20 bp, Artificial
  20-mer unique DNA sequence
ctgttagatggcgccggcga

SEQ ID NO: 9078 - DNA, 20 bp, Artificial
  20-mer unique DNA sequence
ctttcggggggcattcttga

SEQ ID NO: 9079 - DNA, 20 bp, Artificial
  20-mer unique DNA sequence
ttgagccttggacgggtgtg

SEQ ID NO: 9080 - DNA, 20 bp, Artificial
  20-mer unique DNA sequence
ccacttatctggaacgcgcc

SEQ ID NO: 9081 - DNA, 20 bp, Artificial
  20-mer unique DNA sequence
acccgtaccccccctgtccc

SEQ ID NO: 9082 - DNA, 20 bp, Artificial
  20-mer unique DNA sequence
gccagaggacaggggagcaa

SEQ ID NO: 9083 - DNA, 20 bp, Artificial
  20-mer unique DNA sequence
ttttcgggttcgggtccagg

SEQ ID NO: 9084 - DNA, 20 bp, Artificial
  20-mer unique DNA sequence
tgtgataacccaaagcgcgc

SEQ ID NO: 9085 - DNA, 20 bp, Artificial
  20-mer unique DNA sequence
ccgattgtggcgctttgctg

SEQ ID NO: 9086 - DNA, 20 bp, Artificial
  20-mer unique DNA sequence
gtggcgtcgggcaagttgag

SEQ ID NO: 9087 - DNA, 20 bp, Artificial
  20-mer unique DNA sequence
cggcggagcggtgttaccaa

SEQ ID NO: 9088 - DNA, 20 bp, Artificial
  20-mer unique DNA sequence
ttcgctcgctccttgccctc

SEQ ID NO: 9089 - DNA, 20 bp, Artificial
  20-mer unique DNA sequence
ggcggagtgtgggaaatgct

SEQ ID NO: 9090 - DNA, 20 bp, Artificial
  20-mer unique DNA sequence
cccacccctccacttctcga

SEQ ID NO: 9091 - DNA, 20 bp, Artificial
  20-mer unique DNA sequence
cctcgcctgaacctaccccg

SEQ ID NO: 9092 - DNA, 20 bp, Artificial
  20-mer unique DNA sequence
accgacgtgattcgccagac

SEQ ID NO: 9093 - DNA, 20 bp, Artificial
  20-mer unique DNA sequence
aaactcacgcgctggcacta

SEQ ID NO: 9094 - DNA, 20 bp, Artificial
  20-mer unique DNA sequence
ccccgcgctccaattatgtt

SEQ ID NO: 9095 - DNA, 20 bp, Artificial
  20-mer unique DNA sequence
tccggtccttcgctctgcca

SEQ ID NO: 9096 - DNA, 20 bp, Artificial
  20-mer unique DNA sequence
tgcagtgcgctacgctacaa

SEQ ID NO: 9097 - DNA, 20 bp, Artificial
  20-mer unique DNA sequence
ggcgggatcacggaaaagag

SEQ ID NO: 9098 - DNA, 20 bp, Artificial
  20-mer unique DNA sequence
aggcagatcgggcggagagt

SEQ ID NO: 9099 - DNA, 20 bp, Artificial
  20-mer unique DNA sequence
taattcaccccccttcccgg

SEQ ID NO: 9100 - DNA, 20 bp, Artificial
  20-mer unique DNA sequence
gacgcgggcacaatttccaa

SEQ ID NO: 9101 - DNA, 20 bp, Artificial
  20-mer unique DNA sequence
actttgtcgaaggccggggc

SEQ ID NO: 9102 - DNA, 20 bp, Artificial
  20-mer unique DNA sequence
ttgaacccacccactgaccg

SEQ ID NO: 9103 - DNA, 20 bp, Artificial
  20-mer unique DNA sequence
gtttcccgatgttgccctgc

SEQ ID NO: 9104 - DNA, 20 bp, Artificial
  20-mer unique DNA sequence
cccaaccgcagagcaagcaa

SEQ ID NO: 9105 - DNA, 20 bp, Artificial
  20-mer unique DNA sequence
ggtgcgatgggaggactgaa

SEQ ID NO: 9106 - DNA, 20 bp, Artificial
  20-mer unique DNA sequence
acctctgagagccgtgccaa

SEQ ID NO: 9107 - DNA, 20 bp, Artificial
  20-mer unique DNA sequence
tagccacgtacctcaccgga

SEQ ID NO: 9108 - DNA, 20 bp, Artificial
  20-mer unique DNA sequence
cggcgccaaaagcaacctat

SEQ ID NO: 9109 - DNA, 20 bp, Artificial
  20-mer unique DNA sequence
gttggctcggttggcggatg

SEQ ID NO: 9110 - DNA, 20 bp, Artificial
  20-mer unique DNA sequence
tgtcatgatcgcccgaaaaa

SEQ ID NO: 9111 - DNA, 20 bp, Artificial
  20-mer unique DNA sequence
agggaagaagcgaccaccga

SEQ ID NO: 9112 - DNA, 20 bp, Artificial
  20-mer unique DNA sequence
gtgcgaggagaacagtggcg

SEQ ID NO: 9113 - DNA, 20 bp, Artificial
  20-mer unique DNA sequence
cccgacgacaaacacctgcc

SEQ ID NO: 9114 - DNA, 20 bp, Artificial
  20-mer unique DNA sequence
ggcgctcaaaggtatccccc

SEQ ID NO: 9115 - DNA, 20 bp, Artificial
  20-mer unique DNA sequence
cagggaccacggcatagcga

SEQ ID NO: 9116 - DNA, 20 bp, Artificial
  20-mer unique DNA sequence
cgccctctaccctgcttccc

SEQ ID NO: 9117 - DNA, 20 bp, Artificial
  20-mer unique DNA sequence
gttgcgaggagatggagcgt

SEQ ID NO: 9118 - DNA, 20 bp, Artificial
  20-mer unique DNA sequence
atgggcggccacctgactaa

SEQ ID NO: 9119 - DNA, 20 bp, Artificial
  20-mer unique DNA sequence
tggctatctgacgctctgcg

SEQ ID NO: 9120 - DNA, 20 bp, Artificial
  20-mer unique DNA sequence
acacccaaccgcgacctgat

SEQ ID NO: 9121 - DNA, 20 bp, Artificial
  20-mer unique DNA sequence
gcttttggggaggttcggtg

SEQ ID NO: 9122 - DNA, 20 bp, Artificial
  20-mer unique DNA sequence
gggagcacacgaaaacgcca

SEQ ID NO: 9123 - DNA, 20 bp, Artificial
  20-mer unique DNA sequence
gtagcgggggacgagtggac

SEQ ID NO: 9124 - DNA, 20 bp, Artificial
  20-mer unique DNA sequence
gaggacggtggggggctatc

SEQ ID NO: 9125 - DNA, 20 bp, Artificial
  20-mer unique DNA sequence
cccggcgtcctgttccatgt

SEQ ID NO: 9126 - DNA, 20 bp, Artificial
  20-mer unique DNA sequence
gcccgctaacgtccgatcaa

SEQ ID NO: 9127 - DNA, 20 bp, Artificial
  20-mer unique DNA sequence
cgccctctctgcctccacac

SEQ ID NO: 9128 - DNA, 20 bp, Artificial
  20-mer unique DNA sequence
atttgcaggcgccgggtaca

SEQ ID NO: 9129 - DNA, 20 bp, Artificial
  20-mer unique DNA sequence
ccttctgacccatcgccgga

SEQ ID NO: 9130 - DNA, 20 bp, Artificial
  20-mer unique DNA sequence
cggcacctcaagcgaaaatg

SEQ ID NO: 9131 - DNA, 20 bp, Artificial
  20-mer unique DNA sequence
ctggggggtttggggcatct

SEQ ID NO: 9132 - DNA, 20 bp, Artificial
  20-mer unique DNA sequence
acttgggatcggtgctcggc

SEQ ID NO: 9133 - DNA, 20 bp, Artificial
  20-mer unique DNA sequence
aagccctccgaaaccccacg

SEQ ID NO: 9134 - DNA, 20 bp, Artificial
  20-mer unique DNA sequence
ccgtggtgccgggatactcg

SEQ ID NO: 9135 - DNA, 20 bp, Artificial
  20-mer unique DNA sequence
tatcgggcgacgaacggttt

SEQ ID NO: 9136 - DNA, 20 bp, Artificial
  20-mer unique DNA sequence
ccgaggaattatggggcgct

SEQ ID NO: 9137 - DNA, 20 bp, Artificial
  20-mer unique DNA sequence
cgggggaactacatggcgca

SEQ ID NO: 9138 - DNA, 20 bp, Artificial
  20-mer unique DNA sequence
tccgcgcctctcaactgtca

SEQ ID NO: 9139 - DNA, 20 bp, Artificial
  20-mer unique DNA sequence
tcgccctcccccgttctaca

SEQ ID NO: 9140 - DNA, 20 bp, Artificial
  20-mer unique DNA sequence
cctaccccaagcccaacgtg

SEQ ID NO: 9141 - DNA, 20 bp, Artificial
  20-mer unique DNA sequence
caagatggaatggcccgcgt

SEQ ID NO: 9142 - DNA, 20 bp, Artificial
  20-mer unique DNA sequence
tccgtacgcgctgggtacaa

SEQ ID NO: 9143 - DNA, 20 bp, Artificial
  20-mer unique DNA sequence
tataccgcgctggcgtacaa

SEQ ID NO: 9144 - DNA, 20 bp, Artificial
  20-mer unique DNA sequence
tcgcgcctcacccttctcat

SEQ ID NO: 9145 - DNA, 20 bp, Artificial
  20-mer unique DNA sequence
ggcaacagcggagcaaggac

SEQ ID NO: 9146 - DNA, 20 bp, Artificial
  20-mer unique DNA sequence
gcaggaatcatcggccggta

SEQ ID NO: 9147 - DNA, 20 bp, Artificial
  20-mer unique DNA sequence
tctcgaattgatggcgctgg

SEQ ID NO: 9148 - DNA, 20 bp, Artificial
  20-mer unique DNA sequence
aacacgcctgatccaccgcc

SEQ ID NO: 9149 - DNA, 20 bp, Artificial
  20-mer unique DNA sequence
ccggtaggggcaaatcgagc

SEQ ID NO: 9150 - DNA, 20 bp, Artificial
  20-mer unique DNA sequence
tgaaggtcctacgcgcaacg

SEQ ID NO: 9151 - DNA, 20 bp, Artificial
  20-mer unique DNA sequence
gttcaccgtgtgacccctga

SEQ ID NO: 9152 - DNA, 20 bp, Artificial
  20-mer unique DNA sequence
cgacccgccacaaacaccag

SEQ ID NO: 9153 - DNA, 20 bp, Artificial
  20-mer unique DNA sequence
tccttaccgagccacccccg

SEQ ID NO: 9154 - DNA, 20 bp, Artificial
  20-mer unique DNA sequence
tcgatgcccacaacaaagcc

SEQ ID NO: 9155 - DNA, 20 bp, Artificial
  20-mer unique DNA sequence
ataggtttcctctgtgcgcg

SEQ ID NO: 9156 - DNA, 20 bp, Artificial
  20-mer unique DNA sequence
ccagggagcgaccccagtaa

SEQ ID NO: 9157 - DNA, 20 bp, Artificial
  20-mer unique DNA sequence
tccgcaagtgacatccgctc

SEQ ID NO: 9158 - DNA, 20 bp, Artificial
  20-mer unique DNA sequence
tctggggaaaacgcgctgga

SEQ ID NO: 9159 - DNA, 20 bp, Artificial
  20-mer unique DNA sequence
gcccggacgaagcatgaaac

SEQ ID NO: 9160 - DNA, 20 bp, Artificial
  20-mer unique DNA sequence
cgactcccggacccaaaggc

SEQ ID NO: 9161 - DNA, 20 bp, Artificial
  20-mer unique DNA sequence
ttcggcgctaaatccgcttc

SEQ ID NO: 9162 - DNA, 20 bp, Artificial
  20-mer unique DNA sequence
ttttgacgccctcgctctgg

SEQ ID NO: 9163 - DNA, 20 bp, Artificial
  20-mer unique DNA sequence
tcgtggatgggagagatgcg

SEQ ID NO: 9164 - DNA, 20 bp, Artificial
  20-mer unique DNA sequence
acgccagacccatacacgca

SEQ ID NO: 9165 - DNA, 20 bp, Artificial
  20-mer unique DNA sequence
cgctttcgctcgtccgttcg

SEQ ID NO: 9166 - DNA, 20 bp, Artificial
  20-mer unique DNA sequence
ccgagaaggatggcgctagc

SEQ ID NO: 9167 - DNA, 20 bp, Artificial
  20-mer unique DNA sequence
tttccttcggccttttgcgc

SEQ ID NO: 9168 - DNA, 20 bp, Artificial
  20-mer unique DNA sequence
agcggggtaggcaattcgga

SEQ ID NO: 9169 - DNA, 20 bp, Artificial
  20-mer unique DNA sequence
cgccgaccgacaaaagcaag

SEQ ID NO: 9170 - DNA, 20 bp, Artificial
  20-mer unique DNA sequence
tccctctcccgccccttagt

SEQ ID NO: 9171 - DNA, 20 bp, Artificial
  20-mer unique DNA sequence
agagggaatgatgcggatgg

SEQ ID NO: 9172 - DNA, 20 bp, Artificial
  20-mer unique DNA sequence
agccccgcagaaatgctcag

SEQ ID NO: 9173 - DNA, 20 bp, Artificial
  20-mer unique DNA sequence
cgcaccctgcaaatcgatga

SEQ ID NO: 9174 - DNA, 20 bp, Artificial
  20-mer unique DNA sequence
tcgctaacaggggggccaaa

SEQ ID NO: 9175 - DNA, 20 bp, Artificial
  20-mer unique DNA sequence
catagccgccaggcaaccaa

SEQ ID NO: 9176 - DNA, 20 bp, Artificial
  20-mer unique DNA sequence
cttggcgtcgaggggtcttg

SEQ ID NO: 9177 - DNA, 20 bp, Artificial
  20-mer unique DNA sequence
cccgtttgatgaccctgcgt

SEQ ID NO: 9178 - DNA, 20 bp, Artificial
  20-mer unique DNA sequence
cggttgacgagggggattgc

SEQ ID NO: 9179 - DNA, 20 bp, Artificial
  20-mer unique DNA sequence
cgtggatggggggaaaacga

SEQ ID NO: 9180 - DNA, 20 bp, Artificial
  20-mer unique DNA sequence
actcgggtgggtactggcgc

SEQ ID NO: 9181 - DNA, 20 bp, Artificial
  20-mer unique DNA sequence
ctgcttgtgcccctctcccg

SEQ ID NO: 9182 - DNA, 20 bp, Artificial
  20-mer unique DNA sequence
ccaagcaaagggcgcaacac

SEQ ID NO: 9183 - DNA, 20 bp, Artificial
  20-mer unique DNA sequence
accgagcataggacctgacg

SEQ ID NO: 9184 - DNA, 20 bp, Artificial
  20-mer unique DNA sequence
cctcctagccgcaacaccca

SEQ ID NO: 9185 - DNA, 20 bp, Artificial
  20-mer unique DNA sequence
cgcctaaacccgcacagcac

SEQ ID NO: 9186 - DNA, 20 bp, Artificial
  20-mer unique DNA sequence
aatatgcggggcggtggaaa

SEQ ID NO: 9187 - DNA, 20 bp, Artificial
  20-mer unique DNA sequence
ccgcgcttggtcttcttcga

SEQ ID NO: 9188 - DNA, 20 bp, Artificial
  20-mer unique DNA sequence
ggcgaggtgcaatgggtgag

SEQ ID NO: 9189 - DNA, 20 bp, Artificial
  20-mer unique DNA sequence
ccgccagtatgaccgaccct

SEQ ID NO: 9190 - DNA, 20 bp, Artificial
  20-mer unique DNA sequence
ctgcgtggctgaatggatgc

SEQ ID NO: 9191 - DNA, 20 bp, Artificial
  20-mer unique DNA sequence
gagaaccgcgctgcacaaac

SEQ ID NO: 9192 - DNA, 20 bp, Artificial
  20-mer unique DNA sequence
tgcggcgtagggttaagggc

SEQ ID NO: 9193 - DNA, 20 bp, Artificial
  20-mer unique DNA sequence
ccgctcccacatcctgccaa

SEQ ID NO: 9194 - DNA, 20 bp, Artificial
  20-mer unique DNA sequence
aggatacgctagtcgcctgc

SEQ ID NO: 9195 - DNA, 20 bp, Artificial
  20-mer unique DNA sequence
agcacgactcctaggtcgca

SEQ ID NO: 9196 - DNA, 20 bp, Artificial
  20-mer unique DNA sequence
atggtcacggcccaaaacgg

SEQ ID NO: 9197 - DNA, 20 bp, Artificial
  20-mer unique DNA sequence
tgaggcgaggtgatgcggat

SEQ ID NO: 9198 - DNA, 20 bp, Artificial
  20-mer unique DNA sequence
gcagacggcctaagtggggg

SEQ ID NO: 9199 - DNA, 20 bp, Artificial
  20-mer unique DNA sequence
gaaaacgtcaagcccccagc

SEQ ID NO: 9200 - DNA, 20 bp, Artificial
  20-mer unique DNA sequence
tccccaaattccccccgtga

SEQ ID NO: 9201 - DNA, 20 bp, Artificial
  20-mer unique DNA sequence
cttcgccgtggtgggctctg

SEQ ID NO: 9202 - DNA, 20 bp, Artificial
  20-mer unique DNA sequence
cgcagtcaaaccaccacgct

SEQ ID NO: 9203 - DNA, 20 bp, Artificial
  20-mer unique DNA sequence
tttgggctctgtgtgcgggg

SEQ ID NO: 9204 - DNA, 20 bp, Artificial
  20-mer unique DNA sequence
agcagacgttgtaacgccga

SEQ ID NO: 9205 - DNA, 20 bp, Artificial
  20-mer unique DNA sequence
tgacgccacaggtgatcgag

SEQ ID NO: 9206 - DNA, 20 bp, Artificial
  20-mer unique DNA sequence
agcgcgcggggtgtatgtat

SEQ ID NO: 9207 - DNA, 20 bp, Artificial
  20-mer unique DNA sequence
cgatcatggtagcggggagg

SEQ ID NO: 9208 - DNA, 20 bp, Artificial
  20-mer unique DNA sequence
tgtgatgcgcgctgcaatga

SEQ ID NO: 9209 - DNA, 20 bp, Artificial
  20-mer unique DNA sequence
gattcccgcataggcacgga

SEQ ID NO: 9210 - DNA, 20 bp, Artificial
  20-mer unique DNA sequence
atggattgcgcagaaggcgt

SEQ ID NO: 9211 - DNA, 20 bp, Artificial
  20-mer unique DNA sequence
ccctttgacccgttcccgtc

SEQ ID NO: 9212 - DNA, 20 bp, Artificial
  20-mer unique DNA sequence
gcaacgatcgacccaagcct

SEQ ID NO: 9213 - DNA, 20 bp, Artificial
  20-mer unique DNA sequence
gccgctagccattcgacctt

SEQ ID NO: 9214 - DNA, 20 bp, Artificial
  20-mer unique DNA sequence
acccggaacaactggccact

SEQ ID NO: 9215 - DNA, 20 bp, Artificial
  20-mer unique DNA sequence
aggcactaacgcagaccggc

SEQ ID NO: 9216 - DNA, 20 bp, Artificial
  20-mer unique DNA sequence
accgtgctcctgctttgccc

SEQ ID NO: 9217 - DNA, 20 bp, Artificial
  20-mer unique DNA sequence
ttgtcccggaacacgctgta

SEQ ID NO: 9218 - DNA, 20 bp, Artificial
  20-mer unique DNA sequence
agggccgggtggtattaggg

SEQ ID NO: 9219 - DNA, 20 bp, Artificial
  20-mer unique DNA sequence
gatgtgcttcagagggcgcc

SEQ ID NO: 9220 - DNA, 20 bp, Artificial
  20-mer unique DNA sequence
tgcggtcctacggtgattcg

SEQ ID NO: 9221 - DNA, 20 bp, Artificial
  20-mer unique DNA sequence
atggcgctccggtacgacta

SEQ ID NO: 9222 - DNA, 20 bp, Artificial
  20-mer unique DNA sequence
ttacaatgcgcgggtcgctt

SEQ ID NO: 9223 - DNA, 20 bp, Artificial
  20-mer unique DNA sequence
gcacgcatgccctacgtgaa

SEQ ID NO: 9224 - DNA, 20 bp, Artificial
  20-mer unique DNA sequence
tcccaaaaggcacccccaac

SEQ ID NO: 9225 - DNA, 20 bp, Artificial
  20-mer unique DNA sequence
tatcgcggtattcgggcagg

SEQ ID NO: 9226 - DNA, 20 bp, Artificial
  20-mer unique DNA sequence
agggcacgggtagaaggcgt

SEQ ID NO: 9227 - DNA, 20 bp, Artificial
  20-mer unique DNA sequence
aggtgaacgaagggcgggtt

SEQ ID NO: 9228 - DNA, 20 bp, Artificial
  20-mer unique DNA sequence
ctcctcccgtcgccggctta

SEQ ID NO: 9229 - DNA, 20 bp, Artificial
  20-mer unique DNA sequence
gcgtccgcacctgctgctaa

SEQ ID NO: 9230 - DNA, 20 bp, Artificial
  20-mer unique DNA sequence
cgggggcaggttcagggtag

SEQ ID NO: 9231 - DNA, 20 bp, Artificial
  20-mer unique DNA sequence
cccattctaccgcgccaagc

SEQ ID NO: 9232 - DNA, 20 bp, Artificial
  20-mer unique DNA sequence
aaaatacccccgtgcgtcgc

SEQ ID NO: 9233 - DNA, 20 bp, Artificial
  20-mer unique DNA sequence
ttcttcatgcctgcccacca

SEQ ID NO: 9234 - DNA, 20 bp, Artificial
  20-mer unique DNA sequence
gggtggtaaggggggagggc

SEQ ID NO: 9235 - DNA, 20 bp, Artificial
  20-mer unique DNA sequence
cccgcgcaaagaaagtaccc

SEQ ID NO: 9236 - DNA, 20 bp, Artificial
  20-mer unique DNA sequence
acggagcgaaatgaagcgcc

SEQ ID NO: 9237 - DNA, 20 bp, Artificial
  20-mer unique DNA sequence
ccgggggtttagctggcgag

SEQ ID NO: 9238 - DNA, 20 bp, Artificial
  20-mer unique DNA sequence
aacgctgggggatttgtggc

SEQ ID NO: 9239 - DNA, 20 bp, Artificial
  20-mer unique DNA sequence
cggaggggtcacgaaagacg

SEQ ID NO: 9240 - DNA, 20 bp, Artificial
  20-mer unique DNA sequence
tccgggtggggtgctatgat

SEQ ID NO: 9241 - DNA, 20 bp, Artificial
  20-mer unique DNA sequence
tttccgatagccgagtgccc

SEQ ID NO: 9242 - DNA, 20 bp, Artificial
  20-mer unique DNA sequence
aataccaaacatgcgccccg

SEQ ID NO: 9243 - DNA, 20 bp, Artificial
  20-mer unique DNA sequence
gcagggaggggcgaaggttg

SEQ ID NO: 9244 - DNA, 20 bp, Artificial
  20-mer unique DNA sequence
tcagtcgggggatttgggtc

SEQ ID NO: 9245 - DNA, 20 bp, Artificial
  20-mer unique DNA sequence
tatccatcacaccgccctgc

SEQ ID NO: 9246 - DNA, 20 bp, Artificial
  20-mer unique DNA sequence
ggctggtcaaaagtgggggg

SEQ ID NO: 9247 - DNA, 20 bp, Artificial
  20-mer unique DNA sequence
actccgcccccatctgaccg

SEQ ID NO: 9248 - DNA, 20 bp, Artificial
  20-mer unique DNA sequence
tgtaccgacccttgaccccc

SEQ ID NO: 9249 - DNA, 20 bp, Artificial
  20-mer unique DNA sequence
gggaggcgtaacatgggcaa

SEQ ID NO: 9250 - DNA, 20 bp, Artificial
  20-mer unique DNA sequence
tgcctcctcctgcccgaatg

SEQ ID NO: 9251 - DNA, 20 bp, Artificial
  20-mer unique DNA sequence
tgcctattcgccgctcactg

SEQ ID NO: 9252 - DNA, 20 bp, Artificial
  20-mer unique DNA sequence
aacaggcggacgggcataag

SEQ ID NO: 9253 - DNA, 20 bp, Artificial
  20-mer unique DNA sequence
gtgggggcagggcgttgtct

SEQ ID NO: 9254 - DNA, 20 bp, Artificial
  20-mer unique DNA sequence
agcagaaaccacgccaacga

SEQ ID NO: 9255 - DNA, 20 bp, Artificial
  20-mer unique DNA sequence
atggaggagggtggactgcg

SEQ ID NO: 9256 - DNA, 20 bp, Artificial
  20-mer unique DNA sequence
caccacctgcccgacgacct

SEQ ID NO: 9257 - DNA, 20 bp, Artificial
  20-mer unique DNA sequence
ccaacgcctgctccattctg

SEQ ID NO: 9258 - DNA, 20 bp, Artificial
  20-mer unique DNA sequence
cacggagatgcgaaaccagc

SEQ ID NO: 9259 - DNA, 20 bp, Artificial
  20-mer unique DNA sequence
gtgccctgcgctcattcaga

SEQ ID NO: 9260 - DNA, 20 bp, Artificial
  20-mer unique DNA sequence
cgcacaaacagaccggccac

SEQ ID NO: 9261 - DNA, 20 bp, Artificial
  20-mer unique DNA sequence
atggcgtcgtttggcttgtg

SEQ ID NO: 9262 - DNA, 20 bp, Artificial
  20-mer unique DNA sequence
taggtgctttggcggagggt

SEQ ID NO: 9263 - DNA, 20 bp, Artificial
  20-mer unique DNA sequence
gactggggcggtgctttgtc

SEQ ID NO: 9264 - DNA, 20 bp, Artificial
  20-mer unique DNA sequence
tgctttgccgttgtccccag

SEQ ID NO: 9265 - DNA, 20 bp, Artificial
  20-mer unique DNA sequence
tgcgagaagcgagggcggta

SEQ ID NO: 9266 - DNA, 20 bp, Artificial
  20-mer unique DNA sequence
ccactcttttcccaccccgc

SEQ ID NO: 9267 - DNA, 20 bp, Artificial
  20-mer unique DNA sequence
caagcagctcggagaccgtt

SEQ ID NO: 9268 - DNA, 20 bp, Artificial
  20-mer unique DNA sequence
gcgccccctccctgacacat

SEQ ID NO: 9269 - DNA, 20 bp, Artificial
  20-mer unique DNA sequence
ttcgtttatgtcgcccgcct

SEQ ID NO: 9270 - DNA, 20 bp, Artificial
  20-mer unique DNA sequence
tgtgggtacggtgcggaagg

SEQ ID NO: 9271 - DNA, 20 bp, Artificial
  20-mer unique DNA sequence
gtgatacggcagcggggaat

SEQ ID NO: 9272 - DNA, 20 bp, Artificial
  20-mer unique DNA sequence
ccccctgcgaatgccttaaa

SEQ ID NO: 9273 - DNA, 20 bp, Artificial
  20-mer unique DNA sequence
gttttccccgcgtttaggcc

SEQ ID NO: 9274 - DNA, 20 bp, Artificial
  20-mer unique DNA sequence
attctctgggctgggcgtgg

SEQ ID NO: 9275 - DNA, 20 bp, Artificial
  20-mer unique DNA sequence
cggaacggcagacaggacgg

SEQ ID NO: 9276 - DNA, 20 bp, Artificial
  20-mer unique DNA sequence
acaacgacccctgccttccg

SEQ ID NO: 9277 - DNA, 20 bp, Artificial
  20-mer unique DNA sequence
gaaggcaggggtggaggcac

SEQ ID NO: 9278 - DNA, 20 bp, Artificial
  20-mer unique DNA sequence
tgtccccgtaaccacgctca

SEQ ID NO: 9279 - DNA, 20 bp, Artificial
  20-mer unique DNA sequence
ccgtccacctccgttccgct

SEQ ID NO: 9280 - DNA, 20 bp, Artificial
  20-mer unique DNA sequence
agggagggaaccaaacggga

SEQ ID NO: 9281 - DNA, 20 bp, Artificial
  20-mer unique DNA sequence
gcaatgggggggtcgtgagg

SEQ ID NO: 9282 - DNA, 20 bp, Artificial
  20-mer unique DNA sequence
caaccccaccgaaaatccgc

SEQ ID NO: 9283 - DNA, 20 bp, Artificial
  20-mer unique DNA sequence
ggaagacggggggtgcgaat

SEQ ID NO: 9284 - DNA, 20 bp, Artificial
  20-mer unique DNA sequence
cgaagcacccagcccaatca

SEQ ID NO: 9285 - DNA, 20 bp, Artificial
  20-mer unique DNA sequence
caacgattcatgagcgcggc

SEQ ID NO: 9286 - DNA, 20 bp, Artificial
  20-mer unique DNA sequence
tgggggggtaggtgacgaga

SEQ ID NO: 9287 - DNA, 20 bp, Artificial
  20-mer unique DNA sequence
caaggctaggcgctcacgat

SEQ ID NO: 9288 - DNA, 20 bp, Artificial
  20-mer unique DNA sequence
ccggagtacggctgctacaa

SEQ ID NO: 9289 - DNA, 20 bp, Artificial
  20-mer unique DNA sequence
aaggccagtcggctgttaca

SEQ ID NO: 9290 - DNA, 20 bp, Artificial
  20-mer unique DNA sequence
tgtcgcgatggccgataaca

SEQ ID NO: 9291 - DNA, 20 bp, Artificial
  20-mer unique DNA sequence
tgtcggctaccgggtcaaca

SEQ ID NO: 9292 - DNA, 20 bp, Artificial
  20-mer unique DNA sequence
ctcgccccacctacccggac

SEQ ID NO: 9293 - DNA, 20 bp, Artificial
  20-mer unique DNA sequence
ccatttcattagcggggggc

SEQ ID NO: 9294 - DNA, 20 bp, Artificial
  20-mer unique DNA sequence
gcgtaaaaggtgcgagccgt

SEQ ID NO: 9295 - DNA, 20 bp, Artificial
  20-mer unique DNA sequence
aagacccgcgcggataacag

SEQ ID NO: 9296 - DNA, 20 bp, Artificial
  20-mer unique DNA sequence
agcaagccaaagccgggaga

SEQ ID NO: 9297 - DNA, 20 bp, Artificial
  20-mer unique DNA sequence
gacgggaaggagcgaggagg

SEQ ID NO: 9298 - DNA, 20 bp, Artificial
  20-mer unique DNA sequence
gaattccggtcccttgccct

SEQ ID NO: 9299 - DNA, 20 bp, Artificial
  20-mer unique DNA sequence
gagggataaggcgcgagcag

SEQ ID NO: 9300 - DNA, 20 bp, Artificial
  20-mer unique DNA sequence
cttggaacatgtcggcgcaa

SEQ ID NO: 9301 - DNA, 20 bp, Artificial
  20-mer unique DNA sequence
atgcacggctgcgcatacaa

SEQ ID NO: 9302 - DNA, 20 bp, Artificial
  20-mer unique DNA sequence
ggattgggagctgggaggag

SEQ ID NO: 9303 - DNA, 20 bp, Artificial
  20-mer unique DNA sequence
agtgttgacgtagagcggcg

SEQ ID NO: 9304 - DNA, 20 bp, Artificial
  20-mer unique DNA sequence
tgaatgttgggctgcggggt

SEQ ID NO: 9305 - DNA, 20 bp, Artificial
  20-mer unique DNA sequence
ccacctctttggtccctcgc

SEQ ID NO: 9306 - DNA, 20 bp, Artificial
  20-mer unique DNA sequence
ttcggggtcgtagggttcca

SEQ ID NO: 9307 - DNA, 20 bp, Artificial
  20-mer unique DNA sequence
tatgatgacaccggcctgcg

SEQ ID NO: 9308 - DNA, 20 bp, Artificial
  20-mer unique DNA sequence
ccgatgtgtgaggcgcactt

SEQ ID NO: 9309 - DNA, 20 bp, Artificial
  20-mer unique DNA sequence
gccacgagggactccgaagc

SEQ ID NO: 9310 - DNA, 20 bp, Artificial
  20-mer unique DNA sequence
tgccgcgtaggtacgcacta

SEQ ID NO: 9311 - DNA, 20 bp, Artificial
  20-mer unique DNA sequence
cctgccatgacgtaccgaca

SEQ ID NO: 9312 - DNA, 20 bp, Artificial
  20-mer unique DNA sequence
agtctcccactccccgcaat

SEQ ID NO: 9313 - DNA, 20 bp, Artificial
  20-mer unique DNA sequence
aggaagacgcaaccaacccg

SEQ ID NO: 9314 - DNA, 20 bp, Artificial
  20-mer unique DNA sequence
cctccaatcctcacctcggc

SEQ ID NO: 9315 - DNA, 20 bp, Artificial
  20-mer unique DNA sequence
tgggaaacaacgtcggagga

SEQ ID NO: 9316 - DNA, 20 bp, Artificial
  20-mer unique DNA sequence
ttgctgtggcggaatgtgga

SEQ ID NO: 9317 - DNA, 20 bp, Artificial
  20-mer unique DNA sequence
acgacgaccccacggacatc

SEQ ID NO: 9318 - DNA, 20 bp, Artificial
  20-mer unique DNA sequence
ccgtgccacaagcgtagcga

SEQ ID NO: 9319 - DNA, 20 bp, Artificial
  20-mer unique DNA sequence
aaccgatggaagggcgcttt

SEQ ID NO: 9320 - DNA, 20 bp, Artificial
  20-mer unique DNA sequence
aggcgcgtaccgggattttg

SEQ ID NO: 9321 - DNA, 20 bp, Artificial
  20-mer unique DNA sequence
tcagtccatccgctatcgcc

SEQ ID NO: 9322 - DNA, 20 bp, Artificial
  20-mer unique DNA sequence
gtcgccatcccctagctcca

SEQ ID NO: 9323 - DNA, 20 bp, Artificial
  20-mer unique DNA sequence
gcacgaatgagacagggcgc

SEQ ID NO: 9324 - DNA, 20 bp, Artificial
  20-mer unique DNA sequence
agcctaattgcgagcggtgg

SEQ ID NO: 9325 - DNA, 20 bp, Artificial
  20-mer unique DNA sequence
cggtcttggatatcgcccca

SEQ ID NO: 9326 - DNA, 20 bp, Artificial
  20-mer unique DNA sequence
tgtgcacggtgtcgccatta

SEQ ID NO: 9327 - DNA, 20 bp, Artificial
  20-mer unique DNA sequence
acacgatctgacgcgtgtgg

SEQ ID NO: 9328 - DNA, 20 bp, Artificial
  20-mer unique DNA sequence
cactggataacgagggccgg

SEQ ID NO: 9329 - DNA, 20 bp, Artificial
  20-mer unique DNA sequence
cctgaaccccccgacagacg

SEQ ID NO: 9330 - DNA, 20 bp, Artificial
  20-mer unique DNA sequence
aaacaacaagggcaacggcg

SEQ ID NO: 9331 - DNA, 20 bp, Artificial
  20-mer unique DNA sequence
gcagggcgccgaaacgatac

SEQ ID NO: 9332 - DNA, 20 bp, Artificial
  20-mer unique DNA sequence
cggacggccctattgcacac

SEQ ID NO: 9333 - DNA, 20 bp, Artificial
  20-mer unique DNA sequence
ttgttgcggctatgtcgggg

SEQ ID NO: 9334 - DNA, 20 bp, Artificial
  20-mer unique DNA sequence
cgaaggcggcgattaatgga

SEQ ID NO: 9335 - DNA, 20 bp, Artificial
  20-mer unique DNA sequence
gtggctactcggacgggggg

SEQ ID NO: 9336 - DNA, 20 bp, Artificial
  20-mer unique DNA sequence
caagggcgtatccacgcgaa

SEQ ID NO: 9337 - DNA, 20 bp, Artificial
  20-mer unique DNA sequence
tgccataaggcttagcgccc

SEQ ID NO: 9338 - DNA, 20 bp, Artificial
  20-mer unique DNA sequence
ttccccgctctccgctcttc

SEQ ID NO: 9339 - DNA, 20 bp, Artificial
  20-mer unique DNA sequence
gtgccacggtagaggtcaca

SEQ ID NO: 9340 - DNA, 20 bp, Artificial
  20-mer unique DNA sequence
gcgccgaaggagggcatagc

SEQ ID NO: 9341 - DNA, 20 bp, Artificial
  20-mer unique DNA sequence
cttggagtttcgggcgagga

SEQ ID NO: 9342 - DNA, 20 bp, Artificial
  20-mer unique DNA sequence
tgccagagtcggctgtacaa

SEQ ID NO: 9343 - DNA, 20 bp, Artificial
  20-mer unique DNA sequence
tccgtcttcccgcgttatgg

SEQ ID NO: 9344 - DNA, 20 bp, Artificial
  20-mer unique DNA sequence
cccccacagaatgagcccca

SEQ ID NO: 9345 - DNA, 20 bp, Artificial
  20-mer unique DNA sequence
ccgtggtgctgcctgttgac

SEQ ID NO: 9346 - DNA, 20 bp, Artificial
  20-mer unique DNA sequence
cccctctggcccctcgttac

SEQ ID NO: 9347 - DNA, 20 bp, Artificial
  20-mer unique DNA sequence
caccaccccgcttccctccc

SEQ ID NO: 9348 - DNA, 20 bp, Artificial
  20-mer unique DNA sequence
agtgtggtgggggggggaca

SEQ ID NO: 9349 - DNA, 20 bp, Artificial
  20-mer unique DNA sequence
tcccgactccaccgtttgcc

SEQ ID NO: 9350 - DNA, 20 bp, Artificial
  20-mer unique DNA sequence
tcggttaagcgcagggcagg

SEQ ID NO: 9351 - DNA, 20 bp, Artificial
  20-mer unique DNA sequence
gatggcgcatagctagccca

SEQ ID NO: 9352 - DNA, 20 bp, Artificial
  20-mer unique DNA sequence
cgccaacccgctttactcgc

SEQ ID NO: 9353 - DNA, 20 bp, Artificial
  20-mer unique DNA sequence
acccccgtcccctgtccaag

SEQ ID NO: 9354 - DNA, 20 bp, Artificial
  20-mer unique DNA sequence
tctcgcccccgaatcatccg

SEQ ID NO: 9355 - DNA, 20 bp, Artificial
  20-mer unique DNA sequence
gggtgacgtatcggcgatgt

SEQ ID NO: 9356 - DNA, 20 bp, Artificial
  20-mer unique DNA sequence
tctgaccgcgccaaactgag

SEQ ID NO: 9357 - DNA, 20 bp, Artificial
  20-mer unique DNA sequence
gtgtaactgcccccctcgga

SEQ ID NO: 9358 - DNA, 20 bp, Artificial
  20-mer unique DNA sequence
gaaagacccgccccgactgt

SEQ ID NO: 9359 - DNA, 20 bp, Artificial
  20-mer unique DNA sequence
ttcggcttggtttttgccgc

SEQ ID NO: 9360 - DNA, 20 bp, Artificial
  20-mer unique DNA sequence
cgagttacggtccgtcgcat

SEQ ID NO: 9361 - DNA, 20 bp, Artificial
  20-mer unique DNA sequence
ccatttacgcaactcccgca

SEQ ID NO: 9362 - DNA, 20 bp, Artificial
  20-mer unique DNA sequence
gctagggaggttggcgcatg

SEQ ID NO: 9363 - DNA, 20 bp, Artificial
  20-mer unique DNA sequence
ggtgctccccgcctgaaatt

SEQ ID NO: 9364 - DNA, 20 bp, Artificial
  20-mer unique DNA sequence
acccaacgaacgatcaccgc

SEQ ID NO: 9365 - DNA, 20 bp, Artificial
  20-mer unique DNA sequence
atttggttgggggatggggg

SEQ ID NO: 9366 - DNA, 20 bp, Artificial
  20-mer unique DNA sequence
aacgagccaaaaccaggggc

SEQ ID NO: 9367 - DNA, 20 bp, Artificial
  20-mer unique DNA sequence
tttctgtcttccccggccga

SEQ ID NO: 9368 - DNA, 20 bp, Artificial
  20-mer unique DNA sequence
agtacgcgcacggtacatct

SEQ ID NO: 9369 - DNA, 20 bp, Artificial
  20-mer unique DNA sequence
gaacaggctcttcacgggga

SEQ ID NO: 9370 - DNA, 20 bp, Artificial
  20-mer unique DNA sequence
gagcgtgcgaaaatggcgta

SEQ ID NO: 9371 - DNA, 20 bp, Artificial
  20-mer unique DNA sequence
ctggtgtcatggtgggccgg

SEQ ID NO: 9372 - DNA, 20 bp, Artificial
  20-mer unique DNA sequence
cgctacacccgaccgactca

SEQ ID NO: 9373 - DNA, 20 bp, Artificial
  20-mer unique DNA sequence
gcaaccccgcaacgtattca

SEQ ID NO: 9374 - DNA, 20 bp, Artificial
  20-mer unique DNA sequence
tggggggcgcattcttgtac

SEQ ID NO: 9375 - DNA, 20 bp, Artificial
  20-mer unique DNA sequence
catcgcccacattagcaccg

SEQ ID NO: 9376 - DNA, 20 bp, Artificial
  20-mer unique DNA sequence
ggggatttcagggccagagg

SEQ ID NO: 9377 - DNA, 20 bp, Artificial
  20-mer unique DNA sequence
attcgtgggggggttgaaca

SEQ ID NO: 9378 - DNA, 20 bp, Artificial
  20-mer unique DNA sequence
tcgaaccaaccataggcccc

SEQ ID NO: 9379 - DNA, 20 bp, Artificial
  20-mer unique DNA sequence
ttttggcggctgcgttcttg

SEQ ID NO: 9380 - DNA, 20 bp, Artificial
  20-mer unique DNA sequence
cgcgactacaagcaccacgg

SEQ ID NO: 9381 - DNA, 20 bp, Artificial
  20-mer unique DNA sequence
cgatgggtggtttttggaga

SEQ ID NO: 9382 - DNA, 20 bp, Artificial
  20-mer unique DNA sequence
tgctcggttcgctctcgctg

SEQ ID NO: 9383 - DNA, 20 bp, Artificial
  20-mer unique DNA sequence
tgcggggcattcaggcgtta

SEQ ID NO: 9384 - DNA, 20 bp, Artificial
  20-mer unique DNA sequence
gacgacacccagcaccagca

SEQ ID NO: 9385 - DNA, 20 bp, Artificial
  20-mer unique DNA sequence
caaccacccaacggcaatcg

SEQ ID NO: 9386 - DNA, 20 bp, Artificial
  20-mer unique DNA sequence
acaaacaatggtgcgccggc

SEQ ID NO: 9387 - DNA, 20 bp, Artificial
  20-mer unique DNA sequence
tcccctgataattggccccg

SEQ ID NO: 9388 - DNA, 20 bp, Artificial
  20-mer unique DNA sequence
acaagcgtcagggggtcgtc

SEQ ID NO: 9389 - DNA, 20 bp, Artificial
  20-mer unique DNA sequence
gctagcccaaccattcgccc

SEQ ID NO: 9390 - DNA, 20 bp, Artificial
  20-mer unique DNA sequence
ggcaaaacgcggattcgagc

SEQ ID NO: 9391 - DNA, 20 bp, Artificial
  20-mer unique DNA sequence
tgtatttgcccgcctttccc

SEQ ID NO: 9392 - DNA, 20 bp, Artificial
  20-mer unique DNA sequence
tcgccgtttagtgagcccgc

SEQ ID NO: 9393 - DNA, 20 bp, Artificial
  20-mer unique DNA sequence
atggatgggacttcgcggac

SEQ ID NO: 9394 - DNA, 20 bp, Artificial
  20-mer unique DNA sequence
tggaatcgggggagttggac

SEQ ID NO: 9395 - DNA, 20 bp, Artificial
  20-mer unique DNA sequence
ccgtgaaacaccccgccttt

SEQ ID NO: 9396 - DNA, 20 bp, Artificial
  20-mer unique DNA sequence
tccgcctggtcatccctcct

SEQ ID NO: 9397 - DNA, 20 bp, Artificial
  20-mer unique DNA sequence
ctcaaggaatggggaaccgc

SEQ ID NO: 9398 - DNA, 20 bp, Artificial
  20-mer unique DNA sequence
accgacgattgccgggttac

SEQ ID NO: 9399 - DNA, 20 bp, Artificial
  20-mer unique DNA sequence
ttagtgccgcgagacactcc

SEQ ID NO: 9400 - DNA, 20 bp, Artificial
  20-mer unique DNA sequence
tgccgggtagtcggtggtga

SEQ ID NO: 9401 - DNA, 20 bp, Artificial
  20-mer unique DNA sequence
actcgagccagcacccggac

SEQ ID NO: 9402 - DNA, 20 bp, Artificial
  20-mer unique DNA sequence
ctgtgggcggataacgtcga

SEQ ID NO: 9403 - DNA, 20 bp, Artificial
  20-mer unique DNA sequence
atcaccttcgcggccttacg

SEQ ID NO: 9404 - DNA, 20 bp, Artificial
  20-mer unique DNA sequence
ccgctgccgaacccatagac

SEQ ID NO: 9405 - DNA, 20 bp, Artificial
  20-mer unique DNA sequence
ccagaggggtggtgcgatga

SEQ ID NO: 9406 - DNA, 20 bp, Artificial
  20-mer unique DNA sequence
ggcaggcgaatgcgaaatgc

SEQ ID NO: 9407 - DNA, 20 bp, Artificial
  20-mer unique DNA sequence
ggctaaaagggccacgggat

SEQ ID NO: 9408 - DNA, 20 bp, Artificial
  20-mer unique DNA sequence
aacccatttccaccgctcgt

SEQ ID NO: 9409 - DNA, 20 bp, Artificial
  20-mer unique DNA sequence
gcaaatgaaggaggccggct

SEQ ID NO: 9410 - DNA, 20 bp, Artificial
  20-mer unique DNA sequence
ccccccttgtcgtccccata

SEQ ID NO: 9411 - DNA, 20 bp, Artificial
  20-mer unique DNA sequence
tgactgagaggggttcggcc

SEQ ID NO: 9412 - DNA, 20 bp, Artificial
  20-mer unique DNA sequence
acccgtgtcgggtaaccttc

SEQ ID NO: 9413 - DNA, 20 bp, Artificial
  20-mer unique DNA sequence
tctcgataggcatcgcaccc

SEQ ID NO: 9414 - DNA, 20 bp, Artificial
  20-mer unique DNA sequence
atcccgtgtcccgttctccc

SEQ ID NO: 9415 - DNA, 20 bp, Artificial
  20-mer unique DNA sequence
cgggacaatggggctggctt

SEQ ID NO: 9416 - DNA, 20 bp, Artificial
  20-mer unique DNA sequence
tcgagcgctacgttccagac

SEQ ID NO: 9417 - DNA, 20 bp, Artificial
  20-mer unique DNA sequence
acggctccctagagcagaga

SEQ ID NO: 9418 - DNA, 20 bp, Artificial
  20-mer unique DNA sequence
tccggccgacgctgtgtatg

SEQ ID NO: 9419 - DNA, 20 bp, Artificial
  20-mer unique DNA sequence
acgcggcaaggtcatgaatg

SEQ ID NO: 9420 - DNA, 20 bp, Artificial
  20-mer unique DNA sequence
ccaagggcatcaggcggtgt

SEQ ID NO: 9421 - DNA, 20 bp, Artificial
  20-mer unique DNA sequence
tccgccaatccaaaccgtcg

SEQ ID NO: 9422 - DNA, 20 bp, Artificial
  20-mer unique DNA sequence
gagcgcgcggaattgtgatg

SEQ ID NO: 9423 - DNA, 20 bp, Artificial
  20-mer unique DNA sequence
aagccctccgcaaacgtgtg

SEQ ID NO: 9424 - DNA, 20 bp, Artificial
  20-mer unique DNA sequence
agcgaatcggggcgtgagtc

SEQ ID NO: 9425 - DNA, 20 bp, Artificial
  20-mer unique DNA sequence
gatttgcttcgaagggggcc

SEQ ID NO: 9426 - DNA, 20 bp, Artificial
  20-mer unique DNA sequence
ggtgtcgggttccttctccg

SEQ ID NO: 9427 - DNA, 20 bp, Artificial
  20-mer unique DNA sequence
ccgtgtcccctgcccttacc

SEQ ID NO: 9428 - DNA, 20 bp, Artificial
  20-mer unique DNA sequence
cggaggcgaagaggggtaag

SEQ ID NO: 9429 - DNA, 20 bp, Artificial
  20-mer unique DNA sequence
cgagcgaaaacaccgggaat

SEQ ID NO: 9430 - DNA, 20 bp, Artificial
  20-mer unique DNA sequence
ccctcatctgccccaaaacg

SEQ ID NO: 9431 - DNA, 20 bp, Artificial
  20-mer unique DNA sequence
ttgacgggggcgtaggtgat

SEQ ID NO: 9432 - DNA, 20 bp, Artificial
  20-mer unique DNA sequence
ggtcgtcatccggaacgact

SEQ ID NO: 9433 - DNA, 20 bp, Artificial
  20-mer unique DNA sequence
ccgtactgcgtagtcggaca

SEQ ID NO: 9434 - DNA, 20 bp, Artificial
  20-mer unique DNA sequence
gacatacccccccaacggca

SEQ ID NO: 9435 - DNA, 20 bp, Artificial
  20-mer unique DNA sequence
tcttgcccccatcacaccgg

SEQ ID NO: 9436 - DNA, 20 bp, Artificial
  20-mer unique DNA sequence
gagggcgtcgctcaagatga

SEQ ID NO: 9437 - DNA, 20 bp, Artificial
  20-mer unique DNA sequence
cgattggcgtcgctcgatga

SEQ ID NO: 9438 - DNA, 20 bp, Artificial
  20-mer unique DNA sequence
cccccacggcattcattacc

SEQ ID NO: 9439 - DNA, 20 bp, Artificial
  20-mer unique DNA sequence
cgaaccgatcactgccgaaa

SEQ ID NO: 9440 - DNA, 20 bp, Artificial
  20-mer unique DNA sequence
tggctggtctcggggctctc

SEQ ID NO: 9441 - DNA, 20 bp, Artificial
  20-mer unique DNA sequence
acctttgtgcccctgaaccg

SEQ ID NO: 9442 - DNA, 20 bp, Artificial
  20-mer unique DNA sequence
cccggatcaacaacccacgt

SEQ ID NO: 9443 - DNA, 20 bp, Artificial
  20-mer unique DNA sequence
gcttccccgtgatcctttgc

SEQ ID NO: 9444 - DNA, 20 bp, Artificial
  20-mer unique DNA sequence
tgcggatattctggcgcacg

SEQ ID NO: 9445 - DNA, 20 bp, Artificial
  20-mer unique DNA sequence
tggttcggcgcgggctagta

SEQ ID NO: 9446 - DNA, 20 bp, Artificial
  20-mer unique DNA sequence
ggggcgtgtgatgtcgatgg

SEQ ID NO: 9447 - DNA, 20 bp, Artificial
  20-mer unique DNA sequence
ctcggcccccctacttcgca

SEQ ID NO: 9448 - DNA, 20 bp, Artificial
  20-mer unique DNA sequence
agtgcaggagagggcgaatc

SEQ ID NO: 9449 - DNA, 20 bp, Artificial
  20-mer unique DNA sequence
aaacaaaacacgctgcctgc

SEQ ID NO: 9450 - DNA, 20 bp, Artificial
  20-mer unique DNA sequence
ccgagggttatcgacgaggg

SEQ ID NO: 9451 - DNA, 20 bp, Artificial
  20-mer unique DNA sequence
tgcggacgggtaggaattgg

SEQ ID NO: 9452 - DNA, 20 bp, Artificial
  20-mer unique DNA sequence
attgcggggctctaagggct

SEQ ID NO: 9453 - DNA, 20 bp, Artificial
  20-mer unique DNA sequence
taagcgatggcccgaagagg

SEQ ID NO: 9454 - DNA, 20 bp, Artificial
  20-mer unique DNA sequence
ggaatggcgagaatgcggag

SEQ ID NO: 9455 - DNA, 20 bp, Artificial
  20-mer unique DNA sequence
cgtgtagggcgctgcttgga

SEQ ID NO: 9456 - DNA, 20 bp, Artificial
  20-mer unique DNA sequence
ctcgactcccgcaacaagcc

SEQ ID NO: 9457 - DNA, 20 bp, Artificial
  20-mer unique DNA sequence
tttggtgcgaaggtgcgtgc

SEQ ID NO: 9458 - DNA, 20 bp, Artificial
  20-mer unique DNA sequence
taaagcgccgcgcgagcagg

SEQ ID NO: 9459 - DNA, 20 bp, Artificial
  20-mer unique DNA sequence
ttcgtctcggggtggctgct

SEQ ID NO: 9460 - DNA, 20 bp, Artificial
  20-mer unique DNA sequence
tcgtttctgtcgctgtgcat

SEQ ID NO: 9461 - DNA, 20 bp, Artificial
  20-mer unique DNA sequence
cccgaaccacagcgacaccc

SEQ ID NO: 9462 - DNA, 20 bp, Artificial
  20-mer unique DNA sequence
ccgcctccccgcctaaaaac

SEQ ID NO: 9463 - DNA, 20 bp, Artificial
  20-mer unique DNA sequence
accgccgaaccctgacctcc

SEQ ID NO: 9464 - DNA, 20 bp, Artificial
  20-mer unique DNA sequence
tgatggcgtccgaggtgaag

SEQ ID NO: 9465 - DNA, 20 bp, Artificial
  20-mer unique DNA sequence
agcggattatgggcggcaag

SEQ ID NO: 9466 - DNA, 20 bp, Artificial
  20-mer unique DNA sequence
gacctgcgaaccccctcctg

SEQ ID NO: 9467 - DNA, 20 bp, Artificial
  20-mer unique DNA sequence
aacagcttggtcgggcagga

SEQ ID NO: 9468 - DNA, 20 bp, Artificial
  20-mer unique DNA sequence
ggtggggggttggggtcact

SEQ ID NO: 9469 - DNA, 20 bp, Artificial
  20-mer unique DNA sequence
tcacggggttcgttcagcac

SEQ ID NO: 9470 - DNA, 20 bp, Artificial
  20-mer unique DNA sequence
ttggacaggcggactgctcg

SEQ ID NO: 9471 - DNA, 20 bp, Artificial
  20-mer unique DNA sequence
tgcccatcatcccgcagtac

SEQ ID NO: 9472 - DNA, 20 bp, Artificial
  20-mer unique DNA sequence
acggtgccctcattttcgga

SEQ ID NO: 9473 - DNA, 20 bp, Artificial
  20-mer unique DNA sequence
accccatgttcgccgttcac

SEQ ID NO: 9474 - DNA, 20 bp, Artificial
  20-mer unique DNA sequence
caccgccaagaatccacgca

SEQ ID NO: 9475 - DNA, 20 bp, Artificial
  20-mer unique DNA sequence
agtgatccgcacggttgcat

SEQ ID NO: 9476 - DNA, 20 bp, Artificial
  20-mer unique DNA sequence
accggcgctgtgccaataaa

SEQ ID NO: 9477 - DNA, 20 bp, Artificial
  20-mer unique DNA sequence
gggtctacgggccacatgct

SEQ ID NO: 9478 - DNA, 20 bp, Artificial
  20-mer unique DNA sequence
cgacgcacccgactcatttg

SEQ ID NO: 9479 - DNA, 20 bp, Artificial
  20-mer unique DNA sequence
aaaagggcagcaggggcagc

SEQ ID NO: 9480 - DNA, 20 bp, Artificial
  20-mer unique DNA sequence
cggtgacaagaggggcgagt

SEQ ID NO: 9481 - DNA, 20 bp, Artificial
  20-mer unique DNA sequence
gcagccgtccacaccaccct

SEQ ID NO: 9482 - DNA, 20 bp, Artificial
  20-mer unique DNA sequence
acctatccccgtcccgcttg

SEQ ID NO: 9483 - DNA, 20 bp, Artificial
  20-mer unique DNA sequence
caggttaagatggcggggcg

SEQ ID NO: 9484 - DNA, 20 bp, Artificial
  20-mer unique DNA sequence
tccgttggtagccctcgctt

SEQ ID NO: 9485 - DNA, 20 bp, Artificial
  20-mer unique DNA sequence
cgtttggattcacccacccc

SEQ ID NO: 9486 - DNA, 20 bp, Artificial
  20-mer unique DNA sequence
agggaggcgctgaatgcaat

SEQ ID NO: 9487 - DNA, 20 bp, Artificial
  20-mer unique DNA sequence
cgggtgggcggattctgata

SEQ ID NO: 9488 - DNA, 20 bp, Artificial
  20-mer unique DNA sequence
ctgaccctagagaccgcgcc

SEQ ID NO: 9489 - DNA, 20 bp, Artificial
  20-mer unique DNA sequence
cgtttaccgtcccgccacag

SEQ ID NO: 9490 - DNA, 20 bp, Artificial
  20-mer unique DNA sequence
accgtgtctgacgtgctctc

SEQ ID NO: 9491 - DNA, 20 bp, Artificial
  20-mer unique DNA sequence
tctgtgtgccgggtggaagg

SEQ ID NO: 9492 - DNA, 20 bp, Artificial
  20-mer unique DNA sequence
tacccgttcctgcattccgc

SEQ ID NO: 9493 - DNA, 20 bp, Artificial
  20-mer unique DNA sequence
cacgccagtctccccctcat

SEQ ID NO: 9494 - DNA, 20 bp, Artificial
  20-mer unique DNA sequence
ggacgggcaagcaggtttca

SEQ ID NO: 9495 - DNA, 20 bp, Artificial
  20-mer unique DNA sequence
cgtgggcgcggggaatagta

SEQ ID NO: 9496 - DNA, 20 bp, Artificial
  20-mer unique DNA sequence
acacggcggggacggacata

SEQ ID NO: 9497 - DNA, 20 bp, Artificial
  20-mer unique DNA sequence
ctcttgatccgacccgccag

SEQ ID NO: 9498 - DNA, 20 bp, Artificial
  20-mer unique DNA sequence
gacgaaaggcagaccccgaa

SEQ ID NO: 9499 - DNA, 20 bp, Artificial
  20-mer unique DNA sequence
aatgcaccgacccacgagcc

SEQ ID NO: 9500 - DNA, 20 bp, Artificial
  20-mer unique DNA sequence
agtggggcaaggttagggca

SEQ ID NO: 9501 - DNA, 20 bp, Artificial
  20-mer unique DNA sequence
gaaaacggagaagggctgcg

SEQ ID NO: 9502 - DNA, 20 bp, Artificial
  20-mer unique DNA sequence
aatcatcaccgcgcacacgt

SEQ ID NO: 9503 - DNA, 20 bp, Artificial
  20-mer unique DNA sequence
ccagaggcatttccccgatc

SEQ ID NO: 9504 - DNA, 20 bp, Artificial
  20-mer unique DNA sequence
gggacatccgtacggcacat

SEQ ID NO: 9505 - DNA, 20 bp, Artificial
  20-mer unique DNA sequence
ggttgtgccgcgaaataggg

SEQ ID NO: 9506 - DNA, 20 bp, Artificial
  20-mer unique DNA sequence
tcgcccacaagcatccatcg

SEQ ID NO: 9507 - DNA, 20 bp, Artificial
  20-mer unique DNA sequence
agtccagccccccccaacta

SEQ ID NO: 9508 - DNA, 20 bp, Artificial
  20-mer unique DNA sequence
ttagcgggtcgttgttggcg

SEQ ID NO: 9509 - DNA, 20 bp, Artificial
  20-mer unique DNA sequence
ttcactcgttacccccccca

SEQ ID NO: 9510 - DNA, 20 bp, Artificial
  20-mer unique DNA sequence
aaacggggtgacggtggctg

SEQ ID NO: 9511 - DNA, 20 bp, Artificial
  20-mer unique DNA sequence
cgccaggtcccccaagtaga

SEQ ID NO: 9512 - DNA, 20 bp, Artificial
  20-mer unique DNA sequence
cgggatggggacggattttc

SEQ ID NO: 9513 - DNA, 20 bp, Artificial
  20-mer unique DNA sequence
cggggttggggaggctagaa

SEQ ID NO: 9514 - DNA, 20 bp, Artificial
  20-mer unique DNA sequence
actaactaccccccccgagc

SEQ ID NO: 9515 - DNA, 20 bp, Artificial
  20-mer unique DNA sequence
gtcggtgtggaagggcgaag

SEQ ID NO: 9516 - DNA, 20 bp, Artificial
  20-mer unique DNA sequence
agggacagcggaccttggtg

SEQ ID NO: 9517 - DNA, 20 bp, Artificial
  20-mer unique DNA sequence
agttggggcgcatggtgaca

SEQ ID NO: 9518 - DNA, 20 bp, Artificial
  20-mer unique DNA sequence
ccttaacagccatcgcgccc

SEQ ID NO: 9519 - DNA, 20 bp, Artificial
  20-mer unique DNA sequence
cccaacatctccccaaggca

SEQ ID NO: 9520 - DNA, 20 bp, Artificial
  20-mer unique DNA sequence
ctgtcccaccccgcaaaatc

SEQ ID NO: 9521 - DNA, 20 bp, Artificial
  20-mer unique DNA sequence
cgatgaagaacgccccccgt

SEQ ID NO: 9522 - DNA, 20 bp, Artificial
  20-mer unique DNA sequence
ggggcacggctgtaatcgag

SEQ ID NO: 9523 - DNA, 20 bp, Artificial
  20-mer unique DNA sequence
acgccgccactgacgaaatg

SEQ ID NO: 9524 - DNA, 20 bp, Artificial
  20-mer unique DNA sequence
ttgtcgtgcacccaggtcaa

SEQ ID NO: 9525 - DNA, 20 bp, Artificial
  20-mer unique DNA sequence
attgggctgcctgcaaggct

SEQ ID NO: 9526 - DNA, 20 bp, Artificial
  20-mer unique DNA sequence
tccataacacagtcgcgggg

SEQ ID NO: 9527 - DNA, 20 bp, Artificial
  20-mer unique DNA sequence
gggtgtctccgatcttggcg

SEQ ID NO: 9528 - DNA, 20 bp, Artificial
  20-mer unique DNA sequence
aacgacggaacaaagcgcaa

SEQ ID NO: 9529 - DNA, 20 bp, Artificial
  20-mer unique DNA sequence
ggcgtggtccgtttctgtca

SEQ ID NO: 9530 - DNA, 20 bp, Artificial
  20-mer unique DNA sequence
aacgcagggggagtaaccga

SEQ ID NO: 9531 - DNA, 20 bp, Artificial
  20-mer unique DNA sequence
tcctccattcggccgttcag

SEQ ID NO: 9532 - DNA, 20 bp, Artificial
  20-mer unique DNA sequence
ggatcggcgctaggggttgc

SEQ ID NO: 9533 - DNA, 20 bp, Artificial
  20-mer unique DNA sequence
cccctctcgcatcggtttga

SEQ ID NO: 9534 - DNA, 20 bp, Artificial
  20-mer unique DNA sequence
taggggcgtaggggtcggga

SEQ ID NO: 9535 - DNA, 20 bp, Artificial
  20-mer unique DNA sequence
cgccacaaaatcagcaccag

SEQ ID NO: 9536 - DNA, 20 bp, Artificial
  20-mer unique DNA sequence
accaccatccaattcccgca

SEQ ID NO: 9537 - DNA, 20 bp, Artificial
  20-mer unique DNA sequence
ccgcgaccgattttaccccc

SEQ ID NO: 9538 - DNA, 20 bp, Artificial
  20-mer unique DNA sequence
atcttcgccctcccctttcg

SEQ ID NO: 9539 - DNA, 20 bp, Artificial
  20-mer unique DNA sequence
atcgcccaccgcctcacaaa

SEQ ID NO: 9540 - DNA, 20 bp, Artificial
  20-mer unique DNA sequence
cgtttaagggcggatgctgg

SEQ ID NO: 9541 - DNA, 20 bp, Artificial
  20-mer unique DNA sequence
ctttgaccgattggggcgtg

SEQ ID NO: 9542 - DNA, 20 bp, Artificial
  20-mer unique DNA sequence
tcggagaggtcggttctggg

SEQ ID NO: 9543 - DNA, 20 bp, Artificial
  20-mer unique DNA sequence
ggattgtggcgcagggggtt

SEQ ID NO: 9544 - DNA, 20 bp, Artificial
  20-mer unique DNA sequence
tgtggtgctggaggtgggag

SEQ ID NO: 9545 - DNA, 20 bp, Artificial
  20-mer unique DNA sequence
cccattgcaccgatccccct

SEQ ID NO: 9546 - DNA, 20 bp, Artificial
  20-mer unique DNA sequence
tgcttccccaccctactgcc

SEQ ID NO: 9547 - DNA, 20 bp, Artificial
  20-mer unique DNA sequence
tccgtgctgtcgtctttccg

SEQ ID NO: 9548 - DNA, 20 bp, Artificial
  20-mer unique DNA sequence
ccggaggccgtaattgcagc

SEQ ID NO: 9549 - DNA, 20 bp, Artificial
  20-mer unique DNA sequence
ccgccgccgttaaagctacc

SEQ ID NO: 9550 - DNA, 20 bp, Artificial
  20-mer unique DNA sequence
cgtttaccgttgccgctccg

SEQ ID NO: 9551 - DNA, 20 bp, Artificial
  20-mer unique DNA sequence
acattggggtcgtgctcgct

SEQ ID NO: 9552 - DNA, 20 bp, Artificial
  20-mer unique DNA sequence
ggacatcttgcggggaccat

SEQ ID NO: 9553 - DNA, 20 bp, Artificial
  20-mer unique DNA sequence
gatttccacccccctctgcg

SEQ ID NO: 9554 - DNA, 20 bp, Artificial
  20-mer unique DNA sequence
aaccagaggggggcacagct

SEQ ID NO: 9555 - DNA, 20 bp, Artificial
  20-mer unique DNA sequence
agtggggttggggggatgga

SEQ ID NO: 9556 - DNA, 20 bp, Artificial
  20-mer unique DNA sequence
tcgtgcctcctttcgttggg

SEQ ID NO: 9557 - DNA, 20 bp, Artificial
  20-mer unique DNA sequence
cttcaactcgggcgccaaac

SEQ ID NO: 9558 - DNA, 20 bp, Artificial
  20-mer unique DNA sequence
gagccgagcgccatgcactt

SEQ ID NO: 9559 - DNA, 20 bp, Artificial
  20-mer unique DNA sequence
ccaaccgaaggcctcgaagc

SEQ ID NO: 9560 - DNA, 20 bp, Artificial
  20-mer unique DNA sequence
catagtttcgcgcccgtgct

SEQ ID NO: 9561 - DNA, 20 bp, Artificial
  20-mer unique DNA sequence
aggtcgggcaaggggcatgt

SEQ ID NO: 9562 - DNA, 20 bp, Artificial
  20-mer unique DNA sequence
cagcgaaaggccgggagagg

SEQ ID NO: 9563 - DNA, 20 bp, Artificial
  20-mer unique DNA sequence
ggctacctgacgggcctgga

SEQ ID NO: 9564 - DNA, 20 bp, Artificial
  20-mer unique DNA sequence
acgaaaacgccaccccactc

SEQ ID NO: 9565 - DNA, 20 bp, Artificial
  20-mer unique DNA sequence
cggtggttgcgatggttgtg

SEQ ID NO: 9566 - DNA, 20 bp, Artificial
  20-mer unique DNA sequence
cacactgccccgtttttgat

SEQ ID NO: 9567 - DNA, 20 bp, Artificial
  20-mer unique DNA sequence
aggccggcgttgcaagttta

SEQ ID NO: 9568 - DNA, 20 bp, Artificial
  20-mer unique DNA sequence
ctagccggccgtcaccaaaa

SEQ ID NO: 9569 - DNA, 20 bp, Artificial
  20-mer unique DNA sequence
aacaacggtgccgcacgatg

SEQ ID NO: 9570 - DNA, 20 bp, Artificial
  20-mer unique DNA sequence
tgctggtccttggggatgtg

SEQ ID NO: 9571 - DNA, 20 bp, Artificial
  20-mer unique DNA sequence
ggtggggcaaagtgggtcgt

SEQ ID NO: 9572 - DNA, 20 bp, Artificial
  20-mer unique DNA sequence
agccatatacctcccgggca

SEQ ID NO: 9573 - DNA, 20 bp, Artificial
  20-mer unique DNA sequence
tgggcaatcatagccgggca

SEQ ID NO: 9574 - DNA, 20 bp, Artificial
  20-mer unique DNA sequence
aatggggaacaacgaaccgg

SEQ ID NO: 9575 - DNA, 20 bp, Artificial
  20-mer unique DNA sequence
atcctgcctgctcctaccgc

SEQ ID NO: 9576 - DNA, 20 bp, Artificial
  20-mer unique DNA sequence
gccggggtgtcagtcgagat

SEQ ID NO: 9577 - DNA, 20 bp, Artificial
  20-mer unique DNA sequence
gcccacccaccgtaaccgaa

SEQ ID NO: 9578 - DNA, 20 bp, Artificial
  20-mer unique DNA sequence
tacggggtggcgagtggttc

SEQ ID NO: 9579 - DNA, 20 bp, Artificial
  20-mer unique DNA sequence
tacccccgctcgcattattc

SEQ ID NO: 9580 - DNA, 20 bp, Artificial
  20-mer unique DNA sequence
cggggtaggagggtagtgcg

SEQ ID NO: 9581 - DNA, 20 bp, Artificial
  20-mer unique DNA sequence
tcttgctatccatcccgggc

SEQ ID NO: 9582 - DNA, 20 bp, Artificial
  20-mer unique DNA sequence
tggcgaaggaaaggcgatca

SEQ ID NO: 9583 - DNA, 20 bp, Artificial
  20-mer unique DNA sequence
gaccggattgggcccttacg

SEQ ID NO: 9584 - DNA, 20 bp, Artificial
  20-mer unique DNA sequence
actgtcccgctgtgctcgtt

SEQ ID NO: 9585 - DNA, 20 bp, Artificial
  20-mer unique DNA sequence
catacaactccgtccgcgcc

SEQ ID NO: 9586 - DNA, 20 bp, Artificial
  20-mer unique DNA sequence
gagctagatcgggggcggtg

SEQ ID NO: 9587 - DNA, 20 bp, Artificial
  20-mer unique DNA sequence
cgtgcgggtgttggggagta

SEQ ID NO: 9588 - DNA, 20 bp, Artificial
  20-mer unique DNA sequence
attatcaccgggacagcgcg

SEQ ID NO: 9589 - DNA, 20 bp, Artificial
  20-mer unique DNA sequence
cccaaggtcaaggcgtccac

SEQ ID NO: 9590 - DNA, 20 bp, Artificial
  20-mer unique DNA sequence
cgtggccctgcggtttgttt

SEQ ID NO: 9591 - DNA, 20 bp, Artificial
  20-mer unique DNA sequence
attccgtcctcattgccccg

SEQ ID NO: 9592 - DNA, 20 bp, Artificial
  20-mer unique DNA sequence
caaacgacagcggcattgca

SEQ ID NO: 9593 - DNA, 20 bp, Artificial
  20-mer unique DNA sequence
attgtggtgccgaccgggtt

SEQ ID NO: 9594 - DNA, 20 bp, Artificial
  20-mer unique DNA sequence
ctaacccgccgtcgtcaccc

SEQ ID NO: 9595 - DNA, 20 bp, Artificial
  20-mer unique DNA sequence
ctagccgccccaccatttca

SEQ ID NO: 9596 - DNA, 20 bp, Artificial
  20-mer unique DNA sequence
acaaacggcggagtgcaggc

SEQ ID NO: 9597 - DNA, 20 bp, Artificial
  20-mer unique DNA sequence
tcactcctcgccccaaacgg

SEQ ID NO: 9598 - DNA, 20 bp, Artificial
  20-mer unique DNA sequence
taatgggaagggacggcagg

SEQ ID NO: 9599 - DNA, 20 bp, Artificial
  20-mer unique DNA sequence
ttttcctgaccaacgccgag

SEQ ID NO: 9600 - DNA, 20 bp, Artificial
  20-mer unique DNA sequence
gctggtgtcgttggcgaggt

SEQ ID NO: 9601 - DNA, 20 bp, Artificial
  20-mer unique DNA sequence
ggcgggtaagcgtcggaaat

SEQ ID NO: 9602 - DNA, 20 bp, Artificial
  20-mer unique DNA sequence
aaaagagtccaacgcccgca

SEQ ID NO: 9603 - DNA, 20 bp, Artificial
  20-mer unique DNA sequence
ctcgttcgcccaatgctcaa

SEQ ID NO: 9604 - DNA, 20 bp, Artificial
  20-mer unique DNA sequence
tgcaggttatgacgtgccct

SEQ ID NO: 9605 - DNA, 20 bp, Artificial
  20-mer unique DNA sequence
gagcaagtgaggtgcctcgt

SEQ ID NO: 9606 - DNA, 20 bp, Artificial
  20-mer unique DNA sequence
taagggggggtcggaaaggt

SEQ ID NO: 9607 - DNA, 20 bp, Artificial
  20-mer unique DNA sequence
cttaacgccctacgcccgga

SEQ ID NO: 9608 - DNA, 20 bp, Artificial
  20-mer unique DNA sequence
gtaatgcaaatccgggggcg

SEQ ID NO: 9609 - DNA, 20 bp, Artificial
  20-mer unique DNA sequence
cgctgtaccggtccctgctt

SEQ ID NO: 9610 - DNA, 20 bp, Artificial
  20-mer unique DNA sequence
cgccaaccatccgcacttcc

SEQ ID NO: 9611 - DNA, 20 bp, Artificial
  20-mer unique DNA sequence
tggggggagaacgggtgagc

SEQ ID NO: 9612 - DNA, 20 bp, Artificial
  20-mer unique DNA sequence
gctcgtttcttgcccgccta

SEQ ID NO: 9613 - DNA, 20 bp, Artificial
  20-mer unique DNA sequence
cgctccaccttaccccatgc

SEQ ID NO: 9614 - DNA, 20 bp, Artificial
  20-mer unique DNA sequence
acccgaggcgactcgctttt

SEQ ID NO: 9615 - DNA, 20 bp, Artificial
  20-mer unique DNA sequence
accctgcctagggacacctt

SEQ ID NO: 9616 - DNA, 20 bp, Artificial
  20-mer unique DNA sequence
gcgatggagggtaggggcaa

SEQ ID NO: 9617 - DNA, 20 bp, Artificial
  20-mer unique DNA sequence
gatggaagaaggcggcggat

SEQ ID NO: 9618 - DNA, 20 bp, Artificial
  20-mer unique DNA sequence
atacgctaggcagaccacgc

SEQ ID NO: 9619 - DNA, 20 bp, Artificial
  20-mer unique DNA sequence
gcgtggatacctgagtgcca

SEQ ID NO: 9620 - DNA, 20 bp, Artificial
  20-mer unique DNA sequence
ctcgttctgatgcggaccgg

SEQ ID NO: 9621 - DNA, 20 bp, Artificial
  20-mer unique DNA sequence
acaacacgagccccaccctc

SEQ ID NO: 9622 - DNA, 20 bp, Artificial
  20-mer unique DNA sequence
ctcaatgcgcgcgaccctac

SEQ ID NO: 9623 - DNA, 20 bp, Artificial
  20-mer unique DNA sequence
gggtggacatgaggtgagcg

SEQ ID NO: 9624 - DNA, 20 bp, Artificial
  20-mer unique DNA sequence
tcgcaccctaggggtatcca

SEQ ID NO: 9625 - DNA, 20 bp, Artificial
  20-mer unique DNA sequence
tacaccggactccgtgagca

SEQ ID NO: 9626 - DNA, 20 bp, Artificial
  20-mer unique DNA sequence
cccgccgctattcttctcgc

SEQ ID NO: 9627 - DNA, 20 bp, Artificial
  20-mer unique DNA sequence
gggacggtggaacatcaggg

SEQ ID NO: 9628 - DNA, 20 bp, Artificial
  20-mer unique DNA sequence
cccacgctagcccacaaccg

SEQ ID NO: 9629 - DNA, 20 bp, Artificial
  20-mer unique DNA sequence
cccgttccgcgtagctgttg

SEQ ID NO: 9630 - DNA, 20 bp, Artificial
  20-mer unique DNA sequence
atgggatgcgttgggttccg

SEQ ID NO: 9631 - DNA, 20 bp, Artificial
  20-mer unique DNA sequence
gcgtggtcttggagcgggtg

SEQ ID NO: 9632 - DNA, 20 bp, Artificial
  20-mer unique DNA sequence
caagatttcggggcgggagt

SEQ ID NO: 9633 - DNA, 20 bp, Artificial
  20-mer unique DNA sequence
ggatgggggggtctaatggg

SEQ ID NO: 9634 - DNA, 20 bp, Artificial
  20-mer unique DNA sequence
tccttaacgatggggcgagc

SEQ ID NO: 9635 - DNA, 20 bp, Artificial
  20-mer unique DNA sequence
tgcctccgccaaatttcccc

SEQ ID NO: 9636 - DNA, 20 bp, Artificial
  20-mer unique DNA sequence
atggggggacgttaacggca

SEQ ID NO: 9637 - DNA, 20 bp, Artificial
  20-mer unique DNA sequence
gcgggtcgtgcctggaagtt

SEQ ID NO: 9638 - DNA, 20 bp, Artificial
  20-mer unique DNA sequence
tggtaaaaacgcgtgcctgc

SEQ ID NO: 9639 - DNA, 20 bp, Artificial
  20-mer unique DNA sequence
ccactgcatgcttgacccgc

SEQ ID NO: 9640 - DNA, 20 bp, Artificial
  20-mer unique DNA sequence
cacctcgaagaacccagccc

SEQ ID NO: 9641 - DNA, 20 bp, Artificial
  20-mer unique DNA sequence
aaaccacacgcacccccagt

SEQ ID NO: 9642 - DNA, 20 bp, Artificial
  20-mer unique DNA sequence
ccacaccccgccatcaagtc

SEQ ID NO: 9643 - DNA, 20 bp, Artificial
  20-mer unique DNA sequence
cgcgggctcttcatcgtgtg

SEQ ID NO: 9644 - DNA, 20 bp, Artificial
  20-mer unique DNA sequence
gttcgtgtgggcatggggtc

SEQ ID NO: 9645 - DNA, 20 bp, Artificial
  20-mer unique DNA sequence
aacagaggacgcacgggagg

SEQ ID NO: 9646 - DNA, 20 bp, Artificial
  20-mer unique DNA sequence
gaggtacatcggtgcgcggg

SEQ ID NO: 9647 - DNA, 20 bp, Artificial
  20-mer unique DNA sequence
cacttaccgacgcccacact

SEQ ID NO: 9648 - DNA, 20 bp, Artificial
  20-mer unique DNA sequence
tcattctgcaaccaacgccc

SEQ ID NO: 9649 - DNA, 20 bp, Artificial
  20-mer unique DNA sequence
ccgcgccatcacttccatca

SEQ ID NO: 9650 - DNA, 20 bp, Artificial
  20-mer unique DNA sequence
accttgtgtatcggggcggc

SEQ ID NO: 9651 - DNA, 20 bp, Artificial
  20-mer unique DNA sequence
caccagggagagagggccgc

SEQ ID NO: 9652 - DNA, 20 bp, Artificial
  20-mer unique DNA sequence
acctcgcgctctcgtctcca

SEQ ID NO: 9653 - DNA, 20 bp, Artificial
  20-mer unique DNA sequence
ccgccccttcctgccttcac

SEQ ID NO: 9654 - DNA, 20 bp, Artificial
  20-mer unique DNA sequence
gactggactagcgggcttgc

SEQ ID NO: 9655 - DNA, 20 bp, Artificial
  20-mer unique DNA sequence
gtggtcgtcgggagttgggt

SEQ ID NO: 9656 - DNA, 20 bp, Artificial
  20-mer unique DNA sequence
attcgtacctgcgttgcccc

SEQ ID NO: 9657 - DNA, 20 bp, Artificial
  20-mer unique DNA sequence
gcgcggccgaaactctatga

SEQ ID NO: 9658 - DNA, 20 bp, Artificial
  20-mer unique DNA sequence
aaggtttggcggtgtttcgg

SEQ ID NO: 9659 - DNA, 20 bp, Artificial
  20-mer unique DNA sequence
gaggcggcggtcggataaac

SEQ ID NO: 9660 - DNA, 20 bp, Artificial
  20-mer unique DNA sequence
aaaacacccagatcgcccca

SEQ ID NO: 9661 - DNA, 20 bp, Artificial
  20-mer unique DNA sequence
gcagggtacagccgggattg

SEQ ID NO: 9662 - DNA, 20 bp, Artificial
  20-mer unique DNA sequence
tagagggccgcggattggta

SEQ ID NO: 9663 - DNA, 20 bp, Artificial
  20-mer unique DNA sequence
gctccgcgcctcaccttagt

SEQ ID NO: 9664 - DNA, 20 bp, Artificial
  20-mer unique DNA sequence
cttggttcgtcccgcttcgg

SEQ ID NO: 9665 - DNA, 20 bp, Artificial
  20-mer unique DNA sequence
catcccagtttcccgcccaa

SEQ ID NO: 9666 - DNA, 20 bp, Artificial
  20-mer unique DNA sequence
ccataatccagccgcaacgc

SEQ ID NO: 9667 - DNA, 20 bp, Artificial
  20-mer unique DNA sequence
accttgctgggaaaagccga

SEQ ID NO: 9668 - DNA, 20 bp, Artificial
  20-mer unique DNA sequence
gtgttgcggcgtggttttgc

SEQ ID NO: 9669 - DNA, 20 bp, Artificial
  20-mer unique DNA sequence
gcaacgacggaggggagtgc

SEQ ID NO: 9670 - DNA, 20 bp, Artificial
  20-mer unique DNA sequence
cggggtaattcggttgcggc

SEQ ID NO: 9671 - DNA, 20 bp, Artificial
  20-mer unique DNA sequence
cagcctccagcaaccgacca

SEQ ID NO: 9672 - DNA, 20 bp, Artificial
  20-mer unique DNA sequence
cggccagaacacatccaccc

SEQ ID NO: 9673 - DNA, 20 bp, Artificial
  20-mer unique DNA sequence
ctttggagagttgcgcgcgg

SEQ ID NO: 9674 - DNA, 20 bp, Artificial
  20-mer unique DNA sequence
tctcagccgcccgataaacc

SEQ ID NO: 9675 - DNA, 20 bp, Artificial
  20-mer unique DNA sequence
gaaggcggcagacgaaaccc

SEQ ID NO: 9676 - DNA, 20 bp, Artificial
  20-mer unique DNA sequence
ggggcgtagggattgggtct

SEQ ID NO: 9677 - DNA, 20 bp, Artificial
  20-mer unique DNA sequence
cggtgggtgcgctctttttt

SEQ ID NO: 9678 - DNA, 20 bp, Artificial
  20-mer unique DNA sequence
ggaccaacccgatggcaaca

SEQ ID NO: 9679 - DNA, 20 bp, Artificial
  20-mer unique DNA sequence
caacatggggtcgcttcctg

SEQ ID NO: 9680 - DNA, 20 bp, Artificial
  20-mer unique DNA sequence
aagcggggcactgggtaaca

SEQ ID NO: 9681 - DNA, 20 bp, Artificial
  20-mer unique DNA sequence
gccgtgtccccgttcgtaaa

SEQ ID NO: 9682 - DNA, 20 bp, Artificial
  20-mer unique DNA sequence
gagatgcatgcgagaccgcg

SEQ ID NO: 9683 - DNA, 20 bp, Artificial
  20-mer unique DNA sequence
ggtaccatgcttcggggcca

SEQ ID NO: 9684 - DNA, 20 bp, Artificial
  20-mer unique DNA sequence
tgcagttattcaggggccgc

SEQ ID NO: 9685 - DNA, 20 bp, Artificial
  20-mer unique DNA sequence
cgccctcctacgttgcaccg

SEQ ID NO: 9686 - DNA, 20 bp, Artificial
  20-mer unique DNA sequence
ccccgaaggcgtcatccaac

SEQ ID NO: 9687 - DNA, 20 bp, Artificial
  20-mer unique DNA sequence
taccaggggggaggcgtcta

SEQ ID NO: 9688 - DNA, 20 bp, Artificial
  20-mer unique DNA sequence
ccttgccttgcgttcccttg

SEQ ID NO: 9689 - DNA, 20 bp, Artificial
  20-mer unique DNA sequence
acaggtgctatgcgggggcc

SEQ ID NO: 9690 - DNA, 20 bp, Artificial
  20-mer unique DNA sequence
gtctggttcgcctaccttgc

SEQ ID NO: 9691 - DNA, 20 bp, Artificial
  20-mer unique DNA sequence
agcctcgccgtttttacccc

SEQ ID NO: 9692 - DNA, 20 bp, Artificial
  20-mer unique DNA sequence
tgggggaagtcacagcgtcg

SEQ ID NO: 9693 - DNA, 20 bp, Artificial
  20-mer unique DNA sequence
gcccagcactttcaaccgcg

SEQ ID NO: 9694 - DNA, 20 bp, Artificial
  20-mer unique DNA sequence
ggtcactcaatcccgcacga

SEQ ID NO: 9695 - DNA, 20 bp, Artificial
  20-mer unique DNA sequence
cggagagcatgcgcaagaaa

SEQ ID NO: 9696 - DNA, 20 bp, Artificial
  20-mer unique DNA sequence
cggtagggcgtcaaaacggt

SEQ ID NO: 9697 - DNA, 20 bp, Artificial
  20-mer unique DNA sequence
acccgccagtccgcgataga

SEQ ID NO: 9698 - DNA, 20 bp, Artificial
  20-mer unique DNA sequence
ccgacaaccaaaccagcccc

SEQ ID NO: 9699 - DNA, 20 bp, Artificial
  20-mer unique DNA sequence
tgaccctcccgcacagcgaa

SEQ ID NO: 9700 - DNA, 20 bp, Artificial
  20-mer unique DNA sequence
gcgccgtccaaactccaaac

SEQ ID NO: 9701 - DNA, 20 bp, Artificial
  20-mer unique DNA sequence
cattctttttgggcccggag

SEQ ID NO: 9702 - DNA, 20 bp, Artificial
  20-mer unique DNA sequence
aagaggcgtgcggggaaagg

SEQ ID NO: 9703 - DNA, 20 bp, Artificial
  20-mer unique DNA sequence
tcgcccaaccacagattcca

SEQ ID NO: 9704 - DNA, 20 bp, Artificial
  20-mer unique DNA sequence
cgctcgcccctttgtgtctc

SEQ ID NO: 9705 - DNA, 20 bp, Artificial
  20-mer unique DNA sequence
agaacaggggatgcggaggg

SEQ ID NO: 9706 - DNA, 20 bp, Artificial
  20-mer unique DNA sequence
aacacgtcccctccccatcc

SEQ ID NO: 9707 - DNA, 20 bp, Artificial
  20-mer unique DNA sequence
caggtacgcgcaggaatggc

SEQ ID NO: 9708 - DNA, 20 bp, Artificial
  20-mer unique DNA sequence
aagtctgcggcgggaatgga

SEQ ID NO: 9709 - DNA, 20 bp, Artificial
  20-mer unique DNA sequence
aagcccaaccccgcgatgta

SEQ ID NO: 9710 - DNA, 20 bp, Artificial
  20-mer unique DNA sequence
tcgcgagcaaggacaacagc

SEQ ID NO: 9711 - DNA, 20 bp, Artificial
  20-mer unique DNA sequence
ctgaggggcatgtcgctgtg

SEQ ID NO: 9712 - DNA, 20 bp, Artificial
  20-mer unique DNA sequence
cggtggacgagtggcgaagc

SEQ ID NO: 9713 - DNA, 20 bp, Artificial
  20-mer unique DNA sequence
tcgtgtggctcgtcgtgaaa

SEQ ID NO: 9714 - DNA, 20 bp, Artificial
  20-mer unique DNA sequence
gggaataaggcgacgaccag

SEQ ID NO: 9715 - DNA, 20 bp, Artificial
  20-mer unique DNA sequence
ctcccccgattctgccttgc

SEQ ID NO: 9716 - DNA, 20 bp, Artificial
  20-mer unique DNA sequence
tggaggctgtgggacacttt

SEQ ID NO: 9717 - DNA, 20 bp, Artificial
  20-mer unique DNA sequence
tacccctccgcttcctcggt

SEQ ID NO: 9718 - DNA, 20 bp, Artificial
  20-mer unique DNA sequence
taccgcaagcctccacgtcc

SEQ ID NO: 9719 - DNA, 20 bp, Artificial
  20-mer unique DNA sequence
agcaagcacggggcaaggac

SEQ ID NO: 9720 - DNA, 20 bp, Artificial
  20-mer unique DNA sequence
aatgccaacccgaaaacccg

SEQ ID NO: 9721 - DNA, 20 bp, Artificial
  20-mer unique DNA sequence
cggttcccacctcccttgaa

SEQ ID NO: 9722 - DNA, 20 bp, Artificial
  20-mer unique DNA sequence
gatccacacttaggcgggct

SEQ ID NO: 9723 - DNA, 20 bp, Artificial
  20-mer unique DNA sequence
agtacacgcgctagtgtgcc

SEQ ID NO: 9724 - DNA, 20 bp, Artificial
  20-mer unique DNA sequence
tgcgcacgttcttccatcca

SEQ ID NO: 9725 - DNA, 20 bp, Artificial
  20-mer unique DNA sequence
tggcattttcttccccgacg

SEQ ID NO: 9726 - DNA, 20 bp, Artificial
  20-mer unique DNA sequence
cccaacaaaaaccacgcgaa

SEQ ID NO: 9727 - DNA, 20 bp, Artificial
  20-mer unique DNA sequence
gcgcagcaaacagagcaggg

SEQ ID NO: 9728 - DNA, 20 bp, Artificial
  20-mer unique DNA sequence
ggggacaaaaggcggcagga

SEQ ID NO: 9729 - DNA, 20 bp, Artificial
  20-mer unique DNA sequence
gaggttgttttcggcaggcg

SEQ ID NO: 9730 - DNA, 20 bp, Artificial
  20-mer unique DNA sequence
acatccgcctattcccccgc

SEQ ID NO: 9731 - DNA, 20 bp, Artificial
  20-mer unique DNA sequence
tgtccttgccccgacctttt

SEQ ID NO: 9732 - DNA, 20 bp, Artificial
  20-mer unique DNA sequence
tcgctcccatcccaatcccc

SEQ ID NO: 9733 - DNA, 20 bp, Artificial
  20-mer unique DNA sequence
gccattcggggggggtactc

SEQ ID NO: 9734 - DNA, 20 bp, Artificial
  20-mer unique DNA sequence
ccaccttctcgttgctcccc

SEQ ID NO: 9735 - DNA, 20 bp, Artificial
  20-mer unique DNA sequence
cgtgcaatcctacccccgga

SEQ ID NO: 9736 - DNA, 20 bp, Artificial
  20-mer unique DNA sequence
cgctgtgctcgtgggctgtt

SEQ ID NO: 9737 - DNA, 20 bp, Artificial
  20-mer unique DNA sequence
ttgaggcttgttcgggggtg

SEQ ID NO: 9738 - DNA, 20 bp, Artificial
  20-mer unique DNA sequence
tatgacaccctgaaccggcc

SEQ ID NO: 9739 - DNA, 20 bp, Artificial
  20-mer unique DNA sequence
atgatcgcgcgccctccttt

SEQ ID NO: 9740 - DNA, 20 bp, Artificial
  20-mer unique DNA sequence
tgccgaaacaagcctcccac

SEQ ID NO: 9741 - DNA, 20 bp, Artificial
  20-mer unique DNA sequence
ctgcgccctcctcattgttg

SEQ ID NO: 9742 - DNA, 20 bp, Artificial
  20-mer unique DNA sequence
cgacacgtgttctcaaggcg

SEQ ID NO: 9743 - DNA, 20 bp, Artificial
  20-mer unique DNA sequence
agttggaccgcctaagcgac

SEQ ID NO: 9744 - DNA, 20 bp, Artificial
  20-mer unique DNA sequence
ggtgtaggcgggggtaaggc

SEQ ID NO: 9745 - DNA, 20 bp, Artificial
  20-mer unique DNA sequence
tcgtggggcatttcagcatc

SEQ ID NO: 9746 - DNA, 20 bp, Artificial
  20-mer unique DNA sequence
ggcctgccccccattgccta

SEQ ID NO: 9747 - DNA, 20 bp, Artificial
  20-mer unique DNA sequence
agcgaggtggagagtggggg

SEQ ID NO: 9748 - DNA, 20 bp, Artificial
  20-mer unique DNA sequence
ggctgagaggggcgagacgg

SEQ ID NO: 9749 - DNA, 20 bp, Artificial
  20-mer unique DNA sequence
catcagcccgcccaccatag

SEQ ID NO: 9750 - DNA, 20 bp, Artificial
  20-mer unique DNA sequence
aacattaacccgcctcccgc

SEQ ID NO: 9751 - DNA, 20 bp, Artificial
  20-mer unique DNA sequence
gcaaggaagggcgtcggatc

SEQ ID NO: 9752 - DNA, 20 bp, Artificial
  20-mer unique DNA sequence
cagggggatgggtttaggcg

SEQ ID NO: 9753 - DNA, 20 bp, Artificial
  20-mer unique DNA sequence
tattgagcttcggcgcggac

SEQ ID NO: 9754 - DNA, 20 bp, Artificial
  20-mer unique DNA sequence
tgggatcgcaacaaaaccgg

SEQ ID NO: 9755 - DNA, 20 bp, Artificial
  20-mer unique DNA sequence
cgggcggcgcttcaattatg

SEQ ID NO: 9756 - DNA, 20 bp, Artificial
  20-mer unique DNA sequence
tcattacccctcacgtgccg

SEQ ID NO: 9757 - DNA, 20 bp, Artificial
  20-mer unique DNA sequence
tgaagcatcctcccaaccgg

SEQ ID NO: 9758 - DNA, 20 bp, Artificial
  20-mer unique DNA sequence
gtgcccttgcgcttgattga

SEQ ID NO: 9759 - DNA, 20 bp, Artificial
  20-mer unique DNA sequence
tggaccgcacccctctacgc

SEQ ID NO: 9760 - DNA, 20 bp, Artificial
  20-mer unique DNA sequence
tttggttccctggcctctgc

SEQ ID NO: 9761 - DNA, 20 bp, Artificial
  20-mer unique DNA sequence
cgggcgcttctagcttcgat

SEQ ID NO: 9762 - DNA, 20 bp, Artificial
  20-mer unique DNA sequence
ccccaggtccagaaacaggc

SEQ ID NO: 9763 - DNA, 20 bp, Artificial
  20-mer unique DNA sequence
attggctttttggcggctgc

SEQ ID NO: 9764 - DNA, 20 bp, Artificial
  20-mer unique DNA sequence
aacggggaggcggggtatta

SEQ ID NO: 9765 - DNA, 20 bp, Artificial
  20-mer unique DNA sequence
ggtcgtgcttcgtcgtctgg

SEQ ID NO: 9766 - DNA, 20 bp, Artificial
  20-mer unique DNA sequence
tgcgtgcgatggtgctttcc

SEQ ID NO: 9767 - DNA, 20 bp, Artificial
  20-mer unique DNA sequence
atggcggactcttggcgttg

SEQ ID NO: 9768 - DNA, 20 bp, Artificial
  20-mer unique DNA sequence
cctttgagttgtgtgcgccg

SEQ ID NO: 9769 - DNA, 20 bp, Artificial
  20-mer unique DNA sequence
gcttgctcggtcggggctta

SEQ ID NO: 9770 - DNA, 20 bp, Artificial
  20-mer unique DNA sequence
cctgtatcggactgccgtgt

SEQ ID NO: 9771 - DNA, 20 bp, Artificial
  20-mer unique DNA sequence
atgaacgggcccctacagga

SEQ ID NO: 9772 - DNA, 20 bp, Artificial
  20-mer unique DNA sequence
aggaggtgagcgcggattgt

SEQ ID NO: 9773 - DNA, 20 bp, Artificial
  20-mer unique DNA sequence
ccttctcccttggcgcctcg

SEQ ID NO: 9774 - DNA, 20 bp, Artificial
  20-mer unique DNA sequence
gcattctgtccgcactcccg

SEQ ID NO: 9775 - DNA, 20 bp, Artificial
  20-mer unique DNA sequence
tctgcatttggggacgcctt

SEQ ID NO: 9776 - DNA, 20 bp, Artificial
  20-mer unique DNA sequence
cgtcctgtaccccctactgc

SEQ ID NO: 9777 - DNA, 20 bp, Artificial
  20-mer unique DNA sequence
ctgtggtcgtagtcgcggcg

SEQ ID NO: 9778 - DNA, 20 bp, Artificial
  20-mer unique DNA sequence
tcaatgcccttcccaattgc

SEQ ID NO: 9779 - DNA, 20 bp, Artificial
  20-mer unique DNA sequence
tacaaagggcgggaacgggg

SEQ ID NO: 9780 - DNA, 20 bp, Artificial
  20-mer unique DNA sequence
cgtcgttgccgggatctcag

SEQ ID NO: 9781 - DNA, 20 bp, Artificial
  20-mer unique DNA sequence
ccgagcccaagacgtttcca

SEQ ID NO: 9782 - DNA, 20 bp, Artificial
  20-mer unique DNA sequence
gctgctggggtgtggtcgtt

SEQ ID NO: 9783 - DNA, 20 bp, Artificial
  20-mer unique DNA sequence
gggatcagcggggaggaatt

SEQ ID NO: 9784 - DNA, 20 bp, Artificial
  20-mer unique DNA sequence
cgtgaagggcgagtaggcgt

SEQ ID NO: 9785 - DNA, 20 bp, Artificial
  20-mer unique DNA sequence
agcacgcaacagaccgcact

SEQ ID NO: 9786 - DNA, 20 bp, Artificial
  20-mer unique DNA sequence
cggggtggcggctagtatgt

SEQ ID NO: 9787 - DNA, 20 bp, Artificial
  20-mer unique DNA sequence
ataggccaaacacggggggg

SEQ ID NO: 9788 - DNA, 20 bp, Artificial
  20-mer unique DNA sequence
ctcggccacctcaaaccccc

SEQ ID NO: 9789 - DNA, 20 bp, Artificial
  20-mer unique DNA sequence
tgtaggtgcgcgcttcgggt

SEQ ID NO: 9790 - DNA, 20 bp, Artificial
  20-mer unique DNA sequence
ctgcctcgattgcgctgtcc

SEQ ID NO: 9791 - DNA, 20 bp, Artificial
  20-mer unique DNA sequence
aagtacggccccacctcgcc

SEQ ID NO: 9792 - DNA, 20 bp, Artificial
  20-mer unique DNA sequence
gctgcatgcggcactatcgg

SEQ ID NO: 9793 - DNA, 20 bp, Artificial
  20-mer unique DNA sequence
gaacaggccatgacgcgaaa

SEQ ID NO: 9794 - DNA, 20 bp, Artificial
  20-mer unique DNA sequence
ctgatttccgcgtgcttgcc

SEQ ID NO: 9795 - DNA, 20 bp, Artificial
  20-mer unique DNA sequence
tcggcaggaacagcagcact

SEQ ID NO: 9796 - DNA, 20 bp, Artificial
  20-mer unique DNA sequence
cgctcacacgcaaccaaggg

SEQ ID NO: 9797 - DNA, 20 bp, Artificial
  20-mer unique DNA sequence
ccgccgcacccgttatatca

SEQ ID NO: 9798 - DNA, 20 bp, Artificial
  20-mer unique DNA sequence
agcagagcgagtgacggcag

SEQ ID NO: 9799 - DNA, 20 bp, Artificial
  20-mer unique DNA sequence
aattcatcctagggggcggc

SEQ ID NO: 9800 - DNA, 20 bp, Artificial
  20-mer unique DNA sequence
gaccgtagcgcttttgcggg

SEQ ID NO: 9801 - DNA, 20 bp, Artificial
  20-mer unique DNA sequence
cttggctgcatgcggttgga

SEQ ID NO: 9802 - DNA, 20 bp, Artificial
  20-mer unique DNA sequence
agtattggggttggcgcctg

SEQ ID NO: 9803 - DNA, 20 bp, Artificial
  20-mer unique DNA sequence
ccaagcggagcgagggtatc

SEQ ID NO: 9804 - DNA, 20 bp, Artificial
  20-mer unique DNA sequence
gagcggaacaaagggcgtgg

SEQ ID NO: 9805 - DNA, 20 bp, Artificial
  20-mer unique DNA sequence
ttgcggcccttcctcttggt

SEQ ID NO: 9806 - DNA, 20 bp, Artificial
  20-mer unique DNA sequence
agatcaaaccccccgcgaac

SEQ ID NO: 9807 - DNA, 20 bp, Artificial
  20-mer unique DNA sequence
tgaaacgcagctcgccagga

SEQ ID NO: 9808 - DNA, 20 bp, Artificial
  20-mer unique DNA sequence
gagcggcgttgtctgtgtgg

SEQ ID NO: 9809 - DNA, 20 bp, Artificial
  20-mer unique DNA sequence
tagccccttctctcgcctgg

SEQ ID NO: 9810 - DNA, 20 bp, Artificial
  20-mer unique DNA sequence
cctccagctttgccgtcctc

SEQ ID NO: 9811 - DNA, 20 bp, Artificial
  20-mer unique DNA sequence
ggccgcaccgtctcagcttc

SEQ ID NO: 9812 - DNA, 20 bp, Artificial
  20-mer unique DNA sequence
gggtgggcgacaacgagaag

SEQ ID NO: 9813 - DNA, 20 bp, Artificial
  20-mer unique DNA sequence
gacgctttgttgggccctgt

SEQ ID NO: 9814 - DNA, 20 bp, Artificial
  20-mer unique DNA sequence
tcaggtgccctggaccacat

SEQ ID NO: 9815 - DNA, 20 bp, Artificial
  20-mer unique DNA sequence
agcggggaagggacaaggac

SEQ ID NO: 9816 - DNA, 20 bp, Artificial
  20-mer unique DNA sequence
agaccgctcacgtcgaacct

SEQ ID NO: 9817 - DNA, 20 bp, Artificial
  20-mer unique DNA sequence
attaggtccagctgcggtcc

SEQ ID NO: 9818 - DNA, 20 bp, Artificial
  20-mer unique DNA sequence
taggcgcatgcacgaaaagg

SEQ ID NO: 9819 - DNA, 20 bp, Artificial
  20-mer unique DNA sequence
atggcggagcttggtgagga

SEQ ID NO: 9820 - DNA, 20 bp, Artificial
  20-mer unique DNA sequence
tcgaaccgcggatagctgcc

SEQ ID NO: 9821 - DNA, 20 bp, Artificial
  20-mer unique DNA sequence
ggggagctttggggcatgac

SEQ ID NO: 9822 - DNA, 20 bp, Artificial
  20-mer unique DNA sequence
ggctgcggtgggtcgtgtaa

SEQ ID NO: 9823 - DNA, 20 bp, Artificial
  20-mer unique DNA sequence
gcccgacccgctttgtactc

SEQ ID NO: 9824 - DNA, 20 bp, Artificial
  20-mer unique DNA sequence
cccggttgcttgatcgcttg

SEQ ID NO: 9825 - DNA, 20 bp, Artificial
  20-mer unique DNA sequence
cgggggccagaggggtagag

SEQ ID NO: 9826 - DNA, 20 bp, Artificial
  20-mer unique DNA sequence
ggcacgcaaccaaccagacg

SEQ ID NO: 9827 - DNA, 20 bp, Artificial
  20-mer unique DNA sequence
tcaaaagcggcggacagagg

SEQ ID NO: 9828 - DNA, 20 bp, Artificial
  20-mer unique DNA sequence
gggccgggacgaaaggtgtt

SEQ ID NO: 9829 - DNA, 20 bp, Artificial
  20-mer unique DNA sequence
aacagctattggggtggcgg

SEQ ID NO: 9830 - DNA, 20 bp, Artificial
  20-mer unique DNA sequence
ccttgtgggaccgcggattt

SEQ ID NO: 9831 - DNA, 20 bp, Artificial
  20-mer unique DNA sequence
cgcgaacgggacaactctga

SEQ ID NO: 9832 - DNA, 20 bp, Artificial
  20-mer unique DNA sequence
caggacaggccaagcaccga

SEQ ID NO: 9833 - DNA, 20 bp, Artificial
  20-mer unique DNA sequence
caaggagagacgccccaacg

SEQ ID NO: 9834 - DNA, 20 bp, Artificial
  20-mer unique DNA sequence
tgtccggaagctcgtagggc

SEQ ID NO: 9835 - DNA, 20 bp, Artificial
  20-mer unique DNA sequence
atgccggttctctcgtcccc

SEQ ID NO: 9836 - DNA, 20 bp, Artificial
  20-mer unique DNA sequence
cgcgctaacggtagcccttt

SEQ ID NO: 9837 - DNA, 20 bp, Artificial
  20-mer unique DNA sequence
gctgctccgcgttaagatcg

SEQ ID NO: 9838 - DNA, 20 bp, Artificial
  20-mer unique DNA sequence
caggggcaaagtgggcaagg

SEQ ID NO: 9839 - DNA, 20 bp, Artificial
  20-mer unique DNA sequence
tgcgagggaagttaagccgg

SEQ ID NO: 9840 - DNA, 20 bp, Artificial
  20-mer unique DNA sequence
acacccgtggacctcacttg

SEQ ID NO: 9841 - DNA, 20 bp, Artificial
  20-mer unique DNA sequence
atagcgggactccggtggta

SEQ ID NO: 9842 - DNA, 20 bp, Artificial
  20-mer unique DNA sequence
acggggagcggaacctatca

SEQ ID NO: 9843 - DNA, 20 bp, Artificial
  20-mer unique DNA sequence
atccaggggcgcaatccaat

SEQ ID NO: 9844 - DNA, 20 bp, Artificial
  20-mer unique DNA sequence
tatctttgggctggcgaggg

SEQ ID NO: 9845 - DNA, 20 bp, Artificial
  20-mer unique DNA sequence
ggggtggcagtgttggcgtc

SEQ ID NO: 9846 - DNA, 20 bp, Artificial
  20-mer unique DNA sequence
agtctgccaggctacaccga

SEQ ID NO: 9847 - DNA, 20 bp, Artificial
  20-mer unique DNA sequence
tagggtccagcctgtgggaa

SEQ ID NO: 9848 - DNA, 20 bp, Artificial
  20-mer unique DNA sequence
tctatgtggtgccagagccg

SEQ ID NO: 9849 - DNA, 20 bp, Artificial
  20-mer unique DNA sequence
tcacacgtcatagcgggtgg

SEQ ID NO: 9850 - DNA, 20 bp, Artificial
  20-mer unique DNA sequence
tctcgctcgcactacgacac

SEQ ID NO: 9851 - DNA, 20 bp, Artificial
  20-mer unique DNA sequence
acggtcgcggtcaccagaat

SEQ ID NO: 9852 - DNA, 20 bp, Artificial
  20-mer unique DNA sequence
tgctgtacgcagaaggtcgc

SEQ ID NO: 9853 - DNA, 20 bp, Artificial
  20-mer unique DNA sequence
atcggtgttaggcactcgcc

SEQ ID NO: 9854 - DNA, 20 bp, Artificial
  20-mer unique DNA sequence
atcagccgctcggtggtaac

SEQ ID NO: 9855 - DNA, 20 bp, Artificial
  20-mer unique DNA sequence
cgaagctggcgcgataatgc

SEQ ID NO: 9856 - DNA, 20 bp, Artificial
  20-mer unique DNA sequence
cgtttggtatgaggcgccga

SEQ ID NO: 9857 - DNA, 20 bp, Artificial
  20-mer unique DNA sequence
gcggaaggcggtcaaagaga

SEQ ID NO: 9858 - DNA, 20 bp, Artificial
  20-mer unique DNA sequence
cacatgacggaccgcatcca

SEQ ID NO: 9859 - DNA, 20 bp, Artificial
  20-mer unique DNA sequence
gttatgcagccgctcgccaa

SEQ ID NO: 9860 - DNA, 20 bp, Artificial
  20-mer unique DNA sequence
ttgccactggtcagcagagt

SEQ ID NO: 9861 - DNA, 20 bp, Artificial
  20-mer unique DNA sequence
actggtgtacgtccgaggga

SEQ ID NO: 9862 - DNA, 20 bp, Artificial
  20-mer unique DNA sequence
cgttgtcgttccgacccact

SEQ ID NO: 9863 - DNA, 20 bp, Artificial
  20-mer unique DNA sequence
caccacgcggacgctcaaat

SEQ ID NO: 9864 - DNA, 20 bp, Artificial
  20-mer unique DNA sequence
ctcaggcaaggactcgccaa

SEQ ID NO: 9865 - DNA, 20 bp, Artificial
  20-mer unique DNA sequence
tgtggctctgtccagacgtg

SEQ ID NO: 9866 - DNA, 20 bp, Artificial
  20-mer unique DNA sequence
ttgggtctccaggtccctca

SEQ ID NO: 9867 - DNA, 20 bp, Artificial
  20-mer unique DNA sequence
aaatcccgcgagctactggc

SEQ ID NO: 9868 - DNA, 20 bp, Artificial
  20-mer unique DNA sequence
gaccgggccgtgtaacatca

SEQ ID NO: 9869 - DNA, 20 bp, Artificial
  20-mer unique DNA sequence
ctgcgtgtacgtctcgggaa

SEQ ID NO: 9870 - DNA, 20 bp, Artificial
  20-mer unique DNA sequence
ttacggactggccgctcaac

SEQ ID NO: 9871 - DNA, 20 bp, Artificial
  20-mer unique DNA sequence
caagcccctgagcagaccaa

SEQ ID NO: 9872 - DNA, 20 bp, Artificial
  20-mer unique DNA sequence
gttcgcgcacagttacggca

SEQ ID NO: 9873 - DNA, 20 bp, Artificial
  20-mer unique DNA sequence
cctagcgacggtgcccatta

SEQ ID NO: 9874 - DNA, 20 bp, Artificial
  20-mer unique DNA sequence
ttaggctcacacctggctgg

SEQ ID NO: 9875 - DNA, 20 bp, Artificial
  20-mer unique DNA sequence
agatagctccgagcggccat

SEQ ID NO: 9876 - DNA, 20 bp, Artificial
  20-mer unique DNA sequence
gctcccagcttatacggcct

SEQ ID NO: 9877 - DNA, 20 bp, Artificial
  20-mer unique DNA sequence
tcacgcgtgtcgctagttgc

SEQ ID NO: 9878 - DNA, 20 bp, Artificial
  20-mer unique DNA sequence
ctgacgcgacctatgaccga

SEQ ID NO: 9879 - DNA, 20 bp, Artificial
  20-mer unique DNA sequence
ctgttgcggcacgtccatgt

SEQ ID NO: 9880 - DNA, 20 bp, Artificial
  20-mer unique DNA sequence
acgcccagggcctacactat

SEQ ID NO: 9881 - DNA, 20 bp, Artificial
  20-mer unique DNA sequence
tgtacgcggacttgagtggc

SEQ ID NO: 9882 - DNA, 20 bp, Artificial
  20-mer unique DNA sequence
gatgccctagtgcgtccaga

SEQ ID NO: 9883 - DNA, 20 bp, Artificial
  20-mer unique DNA sequence
tcggttcgccactaggcttc

SEQ ID NO: 9884 - DNA, 20 bp, Artificial
  20-mer unique DNA sequence
atacggtggtaccgtgcctg

SEQ ID NO: 9885 - DNA, 20 bp, Artificial
  20-mer unique DNA sequence
atcaccggcagtgtgggatg

SEQ ID NO: 9886 - DNA, 20 bp, Artificial
  20-mer unique DNA sequence
agacgaatcgctcggcaggt

SEQ ID NO: 9887 - DNA, 20 bp, Artificial
  20-mer unique DNA sequence
ttctgcacgtctcggacgac

SEQ ID NO: 9888 - DNA, 20 bp, Artificial
  20-mer unique DNA sequence
agcccatgggacctacctca

SEQ ID NO: 9889 - DNA, 20 bp, Artificial
  20-mer unique DNA sequence
atgtgggccaggttagtcgc

SEQ ID NO: 9890 - DNA, 20 bp, Artificial
  20-mer unique DNA sequence
tgtcttgtcgtaggtgcccg

SEQ ID NO: 9891 - DNA, 20 bp, Artificial
  20-mer unique DNA sequence
atgacgtcacggaactggca

SEQ ID NO: 9892 - DNA, 20 bp, Artificial
  20-mer unique DNA sequence
tttcaggaccgacacggctc

SEQ ID NO: 9893 - DNA, 20 bp, Artificial
  20-mer unique DNA sequence
gttctgcacgtgctaggggt

SEQ ID NO: 9894 - DNA, 20 bp, Artificial
  20-mer unique DNA sequence
aaatcccaggtgcagcgtga

SEQ ID NO: 9895 - DNA, 20 bp, Artificial
  20-mer unique DNA sequence
aaggcgcatgacggtcccta

SEQ ID NO: 9896 - DNA, 20 bp, Artificial
  20-mer unique DNA sequence
atgtgcactcgcaaccgcct

SEQ ID NO: 9897 - DNA, 20 bp, Artificial
  20-mer unique DNA sequence
gttcccggggctcgaatact

SEQ ID NO: 9898 - DNA, 20 bp, Artificial
  20-mer unique DNA sequence
acgcctagcgcttactccac

SEQ ID NO: 9899 - DNA, 20 bp, Artificial
  20-mer unique DNA sequence
atggtgcccgagggagcatt

SEQ ID NO: 9900 - DNA, 20 bp, Artificial
  20-mer unique DNA sequence
ggtcgagaggcgctaagtga

SEQ ID NO: 9901 - DNA, 20 bp, Artificial
  20-mer unique DNA sequence
taccacccgtgacggtctct

SEQ ID NO: 9902 - DNA, 20 bp, Artificial
  20-mer unique DNA sequence
ggcagcgtacgacgtctcaa

SEQ ID NO: 9903 - DNA, 20 bp, Artificial
  20-mer unique DNA sequence
aaggagagtgcccggagtgt

SEQ ID NO: 9904 - DNA, 20 bp, Artificial
  20-mer unique DNA sequence
tgctcgatccggtaggcaga

SEQ ID NO: 9905 - DNA, 20 bp, Artificial
  20-mer unique DNA sequence
aacgtctgccgacaggagca

SEQ ID NO: 9906 - DNA, 20 bp, Artificial
  20-mer unique DNA sequence
ttcgtaccgaccgggcaatc

SEQ ID NO: 9907 - DNA, 20 bp, Artificial
  20-mer unique DNA sequence
aggcggttcatgtcagggtg

SEQ ID NO: 9908 - DNA, 20 bp, Artificial
  20-mer unique DNA sequence
agcgcttacgcgtcaggaaa

SEQ ID NO: 9909 - DNA, 20 bp, Artificial
  20-mer unique DNA sequence
gcggtgcacataggacaacc

SEQ ID NO: 9910 - DNA, 20 bp, Artificial
  20-mer unique DNA sequence
acgtcgagtaacccgtgcat

SEQ ID NO: 9911 - DNA, 20 bp, Artificial
  20-mer unique DNA sequence
aacagtctggcctgtggcga

SEQ ID NO: 9912 - DNA, 20 bp, Artificial
  20-mer unique DNA sequence
ttgtcggtacgcactctggg

SEQ ID NO: 9913 - DNA, 20 bp, Artificial
  20-mer unique DNA sequence
catcccacggtcggagacat

SEQ ID NO: 9914 - DNA, 20 bp, Artificial
  20-mer unique DNA sequence
cgccagactaggtgtgagca

SEQ ID NO: 9915 - DNA, 20 bp, Artificial
  20-mer unique DNA sequence
aggataccgccgaatgcacg

SEQ ID NO: 9916 - DNA, 20 bp, Artificial
  20-mer unique DNA sequence
tgagggtcctaacctgcgga

SEQ ID NO: 9917 - DNA, 20 bp, Artificial
  20-mer unique DNA sequence
tatgaccgcagtcgccgtga

SEQ ID NO: 9918 - DNA, 20 bp, Artificial
  20-mer unique DNA sequence
tcgtgccacgctagaacctt

SEQ ID NO: 9919 - DNA, 20 bp, Artificial
  20-mer unique DNA sequence
cgacctcgcaggttacgaca

SEQ ID NO: 9920 - DNA, 20 bp, Artificial
  20-mer unique DNA sequence
ataccgtgtcgctcggatgc

SEQ ID NO: 9921 - DNA, 20 bp, Artificial
  20-mer unique DNA sequence
gggactgcccgttgctagtt

SEQ ID NO: 9922 - DNA, 20 bp, Artificial
  20-mer unique DNA sequence
cttggactgcggttccgcta

SEQ ID NO: 9923 - DNA, 20 bp, Artificial
  20-mer unique DNA sequence
tgcacctgggtctcgcgtta

SEQ ID NO: 9924 - DNA, 20 bp, Artificial
  20-mer unique DNA sequence
tttgggacacctgggctctc

SEQ ID NO: 9925 - DNA, 20 bp, Artificial
  20-mer unique DNA sequence
accgcctgcacgtatggcta

SEQ ID NO: 9926 - DNA, 20 bp, Artificial
  20-mer unique DNA sequence
ttgcacctacgtgactgcct

SEQ ID NO: 9927 - DNA, 20 bp, Artificial
  20-mer unique DNA sequence
cgttagtccaggctcgcagt

SEQ ID NO: 9928 - DNA, 20 bp, Artificial
  20-mer unique DNA sequence
gactgtgcgcactgcggtta

SEQ ID NO: 9929 - DNA, 20 bp, Artificial
  20-mer unique DNA sequence
tgccggcgacctaacatgag

SEQ ID NO: 9930 - DNA, 20 bp, Artificial
  20-mer unique DNA sequence
ggatatgcgatcggcccaga

SEQ ID NO: 9931 - DNA, 20 bp, Artificial
  20-mer unique DNA sequence
cctaaaccgggttcgccagt

SEQ ID NO: 9932 - DNA, 20 bp, Artificial
  20-mer unique DNA sequence
agacgcgtaacggcggtctt

SEQ ID NO: 9933 - DNA, 20 bp, Artificial
  20-mer unique DNA sequence
gcctcactacgcgtcagtct

SEQ ID NO: 9934 - DNA, 20 bp, Artificial
  20-mer unique DNA sequence
aagagtccgtgccaacgtct

SEQ ID NO: 9935 - DNA, 20 bp, Artificial
  20-mer unique DNA sequence
tgtaagtcgcgaccggtacg

SEQ ID NO: 9936 - DNA, 20 bp, Artificial
  20-mer unique DNA sequence
ggacatgacacgcggaccta

SEQ ID NO: 9937 - DNA, 20 bp, Artificial
  20-mer unique DNA sequence
ccgttccggtctaagggcaa

SEQ ID NO: 9938 - DNA, 20 bp, Artificial
  20-mer unique DNA sequence
aacgagttcgcgctagacca

SEQ ID NO: 9939 - DNA, 20 bp, Artificial
  20-mer unique DNA sequence
tcttgacgtggacccagtgc

SEQ ID NO: 9940 - DNA, 20 bp, Artificial
  20-mer unique DNA sequence
ttgcacgtgagtcggcctat

SEQ ID NO: 9941 - DNA, 20 bp, Artificial
  20-mer unique DNA sequence
atcacccggtgggctgtatc

SEQ ID NO: 9942 - DNA, 20 bp, Artificial
  20-mer unique DNA sequence
accagtagacgggcacatcg

SEQ ID NO: 9943 - DNA, 20 bp, Artificial
  20-mer unique DNA sequence
atcgtagcgtgcccaaaggt

SEQ ID NO: 9944 - DNA, 20 bp, Artificial
  20-mer unique DNA sequence
gctggtccctgagcgtatca

SEQ ID NO: 9945 - DNA, 20 bp, Artificial
  20-mer unique DNA sequence
cgccctacttgcgtcgagtt

SEQ ID NO: 9946 - DNA, 20 bp, Artificial
  20-mer unique DNA sequence
cccagattagccgacacgct

SEQ ID NO: 9947 - DNA, 20 bp, Artificial
  20-mer unique DNA sequence
gaaggccacctgtgacagca

SEQ ID NO: 9948 - DNA, 20 bp, Artificial
  20-mer unique DNA sequence
ttttgcccggacagctctgg

SEQ ID NO: 9949 - DNA, 20 bp, Artificial
  20-mer unique DNA sequence
ccggcgcttagaggtggtat

SEQ ID NO: 9950 - DNA, 20 bp, Artificial
  20-mer unique DNA sequence
tgtaagtatgcgggccggtt

SEQ ID NO: 9951 - DNA, 20 bp, Artificial
  20-mer unique DNA sequence
ccgtgtcagtccggttcaga

SEQ ID NO: 9952 - DNA, 20 bp, Artificial
  20-mer unique DNA sequence
tgacgacgcagtagggaacc

SEQ ID NO: 9953 - DNA, 20 bp, Artificial
  20-mer unique DNA sequence
actctcagggcacagtgacg

SEQ ID NO: 9954 - DNA, 20 bp, Artificial
  20-mer unique DNA sequence
tggcgtcgacacggaggttt

SEQ ID NO: 9955 - DNA, 20 bp, Artificial
  20-mer unique DNA sequence
tgcccagtctagccctgaca

SEQ ID NO: 9956 - DNA, 20 bp, Artificial
  20-mer unique DNA sequence
atcgtcagaccggcagtgga

SEQ ID NO: 9957 - DNA, 20 bp, Artificial
  20-mer unique DNA sequence
gcagtccacactgcgtccaa

SEQ ID NO: 9958 - DNA, 20 bp, Artificial
  20-mer unique DNA sequence
ggcgttctcacacggactct

SEQ ID NO: 9959 - DNA, 20 bp, Artificial
  20-mer unique DNA sequence
agcgccgcggcttatagtag

SEQ ID NO: 9960 - DNA, 20 bp, Artificial
  20-mer unique DNA sequence
ccgtggcactccgtgagatt

SEQ ID NO: 9961 - DNA, 20 bp, Artificial
  20-mer unique DNA sequence
tcactccggtagggtagcca

SEQ ID NO: 9962 - DNA, 20 bp, Artificial
  20-mer unique DNA sequence
tgctccccgagcgtgcataa

SEQ ID NO: 9963 - DNA, 20 bp, Artificial
  20-mer unique DNA sequence
cgccgtcaatcgtgggactt

SEQ ID NO: 9964 - DNA, 20 bp, Artificial
  20-mer unique DNA sequence
tctctaacgtgcacgaggcg

SEQ ID NO: 9965 - DNA, 20 bp, Artificial
  20-mer unique DNA sequence
gtgtggcactacctagccgt

SEQ ID NO: 9966 - DNA, 20 bp, Artificial
  20-mer unique DNA sequence
tcctctgggactacgcgcaa

SEQ ID NO: 9967 - DNA, 20 bp, Artificial
  20-mer unique DNA sequence
tgggccagacagctaggctt

SEQ ID NO: 9968 - DNA, 20 bp, Artificial
  20-mer unique DNA sequence
tgcgtctgatccgggactgt

SEQ ID NO: 9969 - DNA, 20 bp, Artificial
  20-mer unique DNA sequence
caaaggagtcgcgtcggaca

SEQ ID NO: 9970 - DNA, 20 bp, Artificial
  20-mer unique DNA sequence
ccactagccgtgcgcatact

SEQ ID NO: 9971 - DNA, 20 bp, Artificial
  20-mer unique DNA sequence
gggtcggcactacgttctca

SEQ ID NO: 9972 - DNA, 20 bp, Artificial
  20-mer unique DNA sequence
ttccagtccgctcgtacagc

SEQ ID NO: 9973 - DNA, 20 bp, Artificial
  20-mer unique DNA sequence
ttgcacggccattgtgctcg

SEQ ID NO: 9974 - DNA, 20 bp, Artificial
  20-mer unique DNA sequence
tggtcatacccggagacgca

SEQ ID NO: 9975 - DNA, 20 bp, Artificial
  20-mer unique DNA sequence
gggaggttgcactctggtca

SEQ ID NO: 9976 - DNA, 20 bp, Artificial
  20-mer unique DNA sequence
atgggcgcgcgcagattact

SEQ ID NO: 9977 - DNA, 20 bp, Artificial
  20-mer unique DNA sequence
agggtgcagtcctggctaga

SEQ ID NO: 9978 - DNA, 20 bp, Artificial
  20-mer unique DNA sequence
tgtgccgtgagtgcccagaa

SEQ ID NO: 9979 - DNA, 20 bp, Artificial
  20-mer unique DNA sequence
atgacatgcggtacgcggca

SEQ ID NO: 9980 - DNA, 20 bp, Artificial
  20-mer unique DNA sequence
tagtcggccttatgggcacg

SEQ ID NO: 9981 - DNA, 20 bp, Artificial
  20-mer unique DNA sequence
gtgacgaactcgcggaacga

SEQ ID NO: 9982 - DNA, 20 bp, Artificial
  20-mer unique DNA sequence
gttcacgtcggaactgccca

SEQ ID NO: 9983 - DNA, 20 bp, Artificial
  20-mer unique DNA sequence
tttcggatcccggagtgtcg

SEQ ID NO: 9984 - DNA, 20 bp, Artificial
  20-mer unique DNA sequence
agggagttcgagggcccaaa

SEQ ID NO: 9985 - DNA, 20 bp, Artificial
  20-mer unique DNA sequence
tttcgtagcgtgacgagggc

SEQ ID NO: 9986 - DNA, 20 bp, Artificial
  20-mer unique DNA sequence
atcgcgccagggtgtagaac

SEQ ID NO: 9987 - DNA, 20 bp, Artificial
  20-mer unique DNA sequence
gcgcagtcgtagacggcaat

SEQ ID NO: 9988 - DNA, 20 bp, Artificial
  20-mer unique DNA sequence
caagtgcagtgggactgcct

SEQ ID NO: 9989 - DNA, 20 bp, Artificial
  20-mer unique DNA sequence
ggggttagccgtcggaatga

SEQ ID NO: 9990 - DNA, 20 bp, Artificial
  20-mer unique DNA sequence
gggtatcgtcaccggtcgaa

SEQ ID NO: 9991 - DNA, 20 bp, Artificial
  20-mer unique DNA sequence
gatcgatccaggcaccgtga

SEQ ID NO: 9992 - DNA, 20 bp, Artificial
  20-mer unique DNA sequence
gcgctctagtcggctcgtat

SEQ ID NO: 9993 - DNA, 20 bp, Artificial
  20-mer unique DNA sequence
tcccgtaacgtggcagcact

SEQ ID NO: 9994 - DNA, 6 bp, Artificial Sequence
  gap 6 bp-1
tttaaa

SEQ ID NO: 9995 - DNA, 6 bp, Artificial Sequence
  gap 6 bp-2
gatatc

SEQ ID NO: 9996 - DNA, 6 bp, Artificial Sequence
  gap 6 bp-3
agtatc

SEQ ID NO: 9997 - DNA, 6 bp, Artificial Sequence
  gap 6 bp-4
tttaaa

The invention claimed is:

1. A method for constructing gene-targeted heterozygous *Schizosaccharomyces pombe* mutants, comprising:
   1) constructing a deletion cassette for gene targeting by block PCR or gene synthesis;
   2) introducing the deletion cassette into a *Schizosaccharomyces pombe* strain; and
   3) identifying gene-targeted *Schizosaccharomyces pombe* mutants in which a target gene is replaced by a selectable marker gene of the deletion cassette, wherein the deletion cassette comprises a selectable marker gene; a pair of gene-specific barcode sequences, positioned respectively at both flanks of the selectable marker gene, and a pair of homologous recombination regions, assigned respectively to both sides of the barcode sequences positioned upstream and downstream of the selectable marker gene,
   wherein the homologous recombination regions for block PCR range from 350 bp to 450 bp, and those for gene synthesis ranges from 150 bp to 250 bp, and wherein the barcode sequences are selected from the group consisting of the base sequences of SEQ ID NOs: 18 to 9993,
   wherein for the block PCR, the deletion cassette is constructed by fusing 5' and 3' DNA fragments for the homologous recombination regions separately synthesized by PCR to 5' and 3' ends of a DNA fragment comprising the selectable marker gene and gene-specific barcode sequence through block PCR, and
   wherein for the gene synthesis, the deletion cassette is constructed by designing three DNA fragments of a) the 5' homologous recombination region bearing the 5' barcode, b) the selectable marker, and c) the 3' homologous recombination region bearing the 3' barcode, and connecting these three DNA fragments using 5'- and 3'-link oligos.

2. The method according to claim 1, wherein each of the barcode sequences ranges from 20 bp to 30 bp.

3. The method according to claim 1, wherein the barcode sequences are selected from the group consisting of the sequences of SEQ ID NOs: 18 to 9993 and two of the barcode sequences are respectively assigned upstream and downstream of the selectable marker gene.

4. The method according to claim 1, wherein the selectable marker gene is selected from the group consisting of a kanamycin resistance gene, a neomycin resistance gene, a hygromycin resistance gene, a tetracycline resistance gene, auxotrophic markers, histidinol dehydrogenase (hisD), guanine phosphoribosyltransferase (gpt), hypoxanthine phosphoribosyltransferase (hprt), ura3, ble and sacB.

5. The method according to claim 4, wherein the selectable marker gene is a kanamycin resistance gene.

6. The method of claim 1, wherein the deletion cassette further comprises a pair of universal primers for amplifying the barcode sequences positioned at the 5' side of the selectable marker gene and a pair of universal primers for amplifying the barcode sequences positioned at the 3' side thereof.

7. The method of claim 1, wherein the target gene is selected from the group consisting of erg1, rps901, rpa2, smb1, rps2402, rpl1801, cct1, rpp13702 and pmm1.

8. A library of gene-targeted heterozygous fission yeast mutants prepared by the method according to any one of claims 1, 2-4, 5, 6, and 7.

9. A method of screening a drug's mode of action, comprising:
   1) treating the library of gene-targeted heterozygous fission yeast mutants according to claim 8 with a chemical;
   2) culturing the chemically treated fission yeast mutants;
   3) isolating genomic DNA from the cultured mutants; and
   4) measuring and analyzing growth rates of the mutants with the isolated genomic DNA to detect strains whose relative growth is inhibited.

10. A screening kit for a drug's mode of action, comprising the library of gene-targeted heterozygous fission yeast mutants according to claim 8.

11. The method of screening a drug's mode of action according to claim 9, wherein the growth rate of the mutant is measured by applying the isolated genomic DNA to microarray gene chip or to quantitative real-time PCR.

\* \* \* \* \*